US009824179B2

(12) United States Patent
Sherwood et al.

(10) Patent No.: US 9,824,179 B2
(45) Date of Patent: Nov. 21, 2017

(54) DIAGNOSIS OF LYMPHOID MALIGNANCIES AND MINIMAL RESIDUAL DISEASE DETECTION

(71) Applicants: Adaptive Biotechnologies Corporation, Seattle, WA (US); Fred Hutchinson Cancer Research Center, Seattle, WA (US)

(72) Inventors: Anna M. Sherwood, Seattle, WA (US); Harlan S. Robins, Seattle, WA (US)

(73) Assignees: ADAPTIVE BIOTECHNOLOGIES CORP., Seattle, WA (US); FRED HUTCHINSON CANCER RESEARCH CENTER, Seattle, WA (US)

(*) Notice: Subject to any disclaimer, the term of this patent is extended or adjusted under 35 U.S.C. 154(b) by 0 days.

(21) Appl. No.: 13/708,847

(22) Filed: Dec. 7, 2012

(65) Prior Publication Data

US 2013/0253842 A1 Sep. 26, 2013

Related U.S. Application Data

(60) Provisional application No. 61/569,118, filed on Dec. 9, 2011, provisional application No. 61/644,294, filed on May 8, 2012, provisional application No. 61/726,489, filed on Nov. 14, 2012.

(51) Int. Cl.
*G01N 33/48* (2006.01)
*G06F 19/22* (2011.01)
*C12Q 1/68* (2006.01)

(52) U.S. Cl.
CPC .......... *G06F 19/22* (2013.01); *C12Q 1/6886* (2013.01); *C12Q 2600/112* (2013.01); *C12Q 2600/158* (2013.01)

(58) Field of Classification Search
None
See application file for complete search history.

(56) References Cited

U.S. PATENT DOCUMENTS

| | | |
|---|---|---|
| 3,270,960 A | 9/1966 | Phillips |
| 3,773,919 A | 11/1973 | Boswell et al. |
| 4,474,754 A | 10/1984 | Shimizu et al. |
| 4,683,195 A | 7/1987 | Mullis et al. |
| 4,683,202 A | 7/1987 | Mullis |
| 4,751,188 A | 6/1988 | Valet |
| 4,800,159 A | 1/1989 | Mullis et al. |
| 4,876,189 A | 10/1989 | Schetters |
| 4,942,124 A | 7/1990 | Church |
| 4,965,188 A | 10/1990 | Mullis et al. |
| 5,075,217 A | 12/1991 | Weber |
| 5,126,022 A | 6/1992 | Soane et al. |
| 5,149,625 A | 9/1992 | Church |
| 5,168,038 A | 12/1992 | Tecott et al. |
| 5,189,147 A | 2/1993 | Saito et al. |
| 5,210,015 A | 5/1993 | Gelfand et al. |
| 5,213,960 A | 5/1993 | Chang |
| 5,231,012 A | 7/1993 | Mosmann et al. |
| 5,296,351 A | 3/1994 | Morley |
| 5,298,396 A | 3/1994 | Kotzin et al. |
| 5,326,696 A | 7/1994 | Chang |
| 5,336,598 A | 8/1994 | Kotzin et al. |
| 5,364,759 A | 11/1994 | Caskey |
| 5,399,491 A | 3/1995 | Kacian et al. |
| 5,418,134 A | 5/1995 | Morley |
| 5,449,752 A | 9/1995 | Fujii et al. |

(Continued)

FOREIGN PATENT DOCUMENTS

| | | |
|---|---|---|
| CN | 101225441 A | 7/2008 |
| CN | 102272327 A | 12/2011 |

(Continued)

OTHER PUBLICATIONS

Kneba et al., "Analysis of Rearranged T-cell Receptor /?-Chain Genes by Polymerase Chain Reaction (PCR) DNA Sequencing and Automated High Resolution PCR Fragment Analysis" (Blood, vol. 86 (1995) pp. 3930-3937).*

Theodorou et al. "VJ Rearrangements of the TCRγ Locus in Peripheral T-Cell Lymphomas: Analysis by Polymerase Chain Reaction and Denaturing Gradient Gel Electrophoresis," (Journal of Pathology, vol. 178 (1996) 303-310).*

Rachlin et al. "MuPlex: multi-objective multiplex PCR assay design" (Nucleic Acids Research, vol. 33 (2005) pp. W544-W547).*

Dash et al. 'Paired analysis of TCR_ _and TCR_ _chains at the single-cell level in mice, Journal of Clinical Investigation vol. 121 (2011) pp. 288-295.*

(Continued)

*Primary Examiner* — Anna Skibinsky
(74) *Attorney, Agent, or Firm* — Cooley LLP

(57) ABSTRACT

Methods are described for diagnosis of a lymphoid hematological malignancy in a subject prior to treatment, and for detecting minimal residual disease (MRD) in the subject after treatment for the malignancy, by high throughput quantitative sequencing (HTS) of multiple unique adaptive immune receptor (TCR or Ig) encoding DNA molecules that have been amplified from DNA isolated from blood samples or other lymphoid cell-containing samples. Amplification employs oligonucleotide primer sets designed to amplify CDR3-encoding sequences within substantially all possible human VDJ or VJ combinations. Disease-characteristic adaptive immune receptor clonotypes occur, prior to treatment, at a relative frequency of at least 15-30% of rearranged receptor CDR3-encoding gene regions. Following treatment, persistence of at least one such clonotype at a detectable frequency of at least $10^{-6}$ or at least $10^{-5}$ receptor CDR3-encoding regions indicates MRD. Improved quantitative embodiments are provided by inclusion of a template composition for amplification factor determination and related methods.

21 Claims, 37 Drawing Sheets

(56) References Cited

U.S. PATENT DOCUMENTS

| | | |
|---|---|---|
| 5,498,392 A | 3/1996 | Wilding et al. |
| 5,506,126 A | 4/1996 | Seed et al. |
| 5,587,128 A | 12/1996 | Wilding et al. |
| 5,627,037 A | 5/1997 | Ward |
| 5,627,052 A | 5/1997 | Schrader |
| 5,635,354 A | 6/1997 | Kourilsky et al. |
| 5,667,967 A | 9/1997 | Steinman et al. |
| 5,698,396 A | 12/1997 | Pfreundschuh |
| 5,699,798 A | 12/1997 | Hochman et al. |
| 5,741,676 A | 4/1998 | Fuller |
| 5,742,598 A | 4/1998 | Dunn et al. |
| 5,776,708 A | 7/1998 | Kotzin et al. |
| 5,776,737 A | 7/1998 | Dunn |
| 5,837,447 A | 11/1998 | Gorski |
| 5,846,719 A | 12/1998 | Brenner |
| 5,854,033 A | 12/1998 | Lizardi |
| 5,858,195 A | 1/1999 | Ramsey |
| 5,925,517 A | 7/1999 | Tyagi et al. |
| 5,935,793 A | 8/1999 | Wong |
| 5,969,108 A | 10/1999 | McCafferty et al. |
| 5,981,176 A | 11/1999 | Wallace |
| 5,981,179 A | 11/1999 | Lorinez et al. |
| 6,001,229 A | 12/1999 | Ramsey |
| 6,010,607 A | 1/2000 | Ramsey |
| 6,033,546 A | 3/2000 | Ramsey |
| 6,054,034 A | 4/2000 | Soane et al. |
| 6,087,096 A | 7/2000 | Dau |
| 6,090,592 A | 7/2000 | Adams et al. |
| 6,143,496 A | 11/2000 | Brown et al. |
| 6,172,214 B1 | 1/2001 | Brenner |
| 6,174,670 B1 | 1/2001 | Wittwer et al. |
| 6,258,540 B1 | 7/2001 | Lo et al. |
| 6,258,568 B1 | 7/2001 | Nyren |
| 6,300,070 B1 | 10/2001 | Boles et al. |
| 6,416,948 B1 | 7/2002 | Pilarski |
| 6,440,706 B1 | 8/2002 | Vogelstein et al. |
| 6,458,530 B1 | 10/2002 | Morris et al. |
| 6,489,103 B1 | 12/2002 | Griffiths et al. |
| 6,524,829 B1 | 2/2003 | Seeger |
| 6,569,627 B2 | 5/2003 | Wittwer et al. |
| 6,596,492 B2 | 7/2003 | Avery et al. |
| 6,605,272 B2 | 8/2003 | Novak et al. |
| 6,613,525 B2 | 9/2003 | Nelson et al. |
| 6,667,159 B1 | 12/2003 | Walt |
| 6,753,147 B2 | 6/2004 | Vogelstein et al. |
| 6,787,308 B2 | 9/2004 | Balasubramanian et al. |
| 6,792,355 B2 | 9/2004 | Hansen et al. |
| 6,794,499 B2 | 9/2004 | Wengel et al. |
| 6,806,079 B1 | 10/2004 | McCafferty et al. |
| 6,858,412 B2 | 2/2005 | Willis |
| 6,919,434 B1 | 7/2005 | Goto et al. |
| 6,964,850 B2 | 11/2005 | Bevilacqua et al. |
| 7,068,874 B2 | 6/2006 | Wang et al. |
| 7,112,423 B2 | 9/2006 | Van Ness et al. |
| 7,115,400 B1 | 10/2006 | Adessi et al. |
| 7,148,040 B2 | 12/2006 | Meagher et al. |
| 7,157,228 B2 | 1/2007 | Hashmi et al. |
| 7,157,274 B2 | 1/2007 | Bohm et al. |
| 7,208,795 B2 | 4/2007 | Carver et al. |
| 7,232,653 B1 | 6/2007 | Austrup et al. |
| 7,306,906 B2 | 12/2007 | Maruyama et al. |
| 7,313,308 B2 | 12/2007 | Turner et al. |
| 7,323,305 B2 | 1/2008 | Leamon et al. |
| 7,329,731 B2 | 2/2008 | Jakobsen et al. |
| 7,351,578 B2 | 4/2008 | Cheo et al. |
| 7,365,179 B2 | 4/2008 | Brenner |
| 7,371,519 B2 | 5/2008 | Wolber |
| 7,375,211 B2 | 5/2008 | Kou |
| 7,393,566 B2 | 7/2008 | Miyata |
| 7,432,084 B2 | 10/2008 | Shoemaker |
| 7,537,897 B2 | 5/2009 | Brenner |
| 7,544,473 B2 | 6/2009 | Brenner |
| 7,572,582 B2 | 8/2009 | Wengel et al. |
| 7,662,557 B2 | 2/2010 | McCafferty et al. |
| 7,666,604 B2 | 2/2010 | Jakobsen et al. |
| 7,691,994 B2 | 4/2010 | Brewer |
| 7,700,323 B2 | 4/2010 | Willis et al. |
| 7,741,463 B2 | 6/2010 | Gormley et al. |
| 7,749,697 B2 | 7/2010 | Oleksiewicz et al. |
| 7,785,783 B2 | 8/2010 | Morley et al. |
| 7,833,716 B2 | 11/2010 | Becker et al. |
| 7,842,457 B2 | 11/2010 | Berka et al. |
| 7,862,999 B2 | 1/2011 | Zheng et al. |
| 7,879,324 B2 | 2/2011 | Saxon |
| 7,892,550 B2 | 2/2011 | Dennis et al. |
| 7,907,800 B2 | 3/2011 | Foquet et al. |
| 7,915,015 B2 | 3/2011 | Vogelstein et al. |
| 7,956,043 B2 | 6/2011 | Krieg et al. |
| 7,960,116 B2 | 6/2011 | Eid et al. |
| 8,012,690 B2 | 9/2011 | Berka et al. |
| 8,021,842 B2 | 9/2011 | Brenner |
| 8,030,023 B2 | 10/2011 | Adams et al. |
| 8,048,627 B2 | 11/2011 | Dressman et al. |
| 8,053,188 B2 | 11/2011 | Gullberg et al. |
| 8,053,235 B2 | 11/2011 | Buckner et al. |
| 8,137,569 B2 | 3/2012 | Harnack et al. |
| 8,137,936 B2 | 3/2012 | Macevicz |
| 8,153,375 B2 | 4/2012 | Travers et al. |
| 8,158,359 B2 | 4/2012 | Leamon et al. |
| 8,236,503 B2 | 8/2012 | Faham |
| 8,283,294 B2 | 10/2012 | Kastrup et al. |
| 8,309,312 B2 | 11/2012 | Lang et al. |
| 8,313,625 B2 | 11/2012 | Rothberg et al. |
| 8,318,433 B2 | 11/2012 | Brenner |
| 8,394,590 B2 | 3/2013 | Kwong et al. |
| 8,445,205 B2 | 5/2013 | Brenner |
| 8,481,292 B2 | 7/2013 | Casbon et al. |
| 8,507,205 B2 | 8/2013 | Faham |
| 8,628,927 B2 | 1/2014 | Faham |
| 8,685,678 B2 | 4/2014 | Casbon |
| 8,691,510 B2 | 4/2014 | Faham |
| 8,699,361 B2 | 4/2014 | Jim et al. |
| 8,715,967 B2 | 5/2014 | Casbon |
| 8,722,368 B2 | 5/2014 | Casbon |
| 8,728,766 B2 | 5/2014 | Casbon |
| 8,741,606 B2 | 6/2014 | Casbon |
| 8,748,103 B2 | 6/2014 | Faham |
| 8,759,036 B2 | 6/2014 | Wang |
| 8,795,970 B2 | 8/2014 | Faham |
| 8,826,321 B2 | 9/2014 | Cronin et al. |
| 8,835,358 B2 | 9/2014 | Fodor |
| 8,883,418 B2 * | 11/2014 | Pasqual ............... C12Q 1/6883 |
| | | 435/6.12 |
| 9,012,148 B2 | 4/2015 | Han et al. |
| 9,043,160 B1 | 5/2015 | Moorhead et al. |
| 9,150,905 B2 | 10/2015 | Robins et al. |
| 9,217,176 B2 | 12/2015 | Faham et al. |
| 9,228,232 B2 | 1/2016 | Faham et al. |
| 9,365,901 B2 | 6/2016 | Pepin et al. |
| 9,416,420 B2 | 8/2016 | Faham et al. |
| 9,512,487 B2 | 12/2016 | Faham et al. |
| 9,528,160 B2 | 12/2016 | Pepin et al. |
| 2002/0076725 A1 | 6/2002 | Toyosaki-Maeda et al. |
| 2002/0110807 A1 | 8/2002 | Pilarski et al. |
| 2003/0096277 A1 | 5/2003 | Chen |
| 2003/0120061 A1 | 6/2003 | Zhang |
| 2003/0134326 A1 | 7/2003 | Hansen |
| 2003/0162197 A1 | 8/2003 | Morley |
| 2003/0207300 A1 | 11/2003 | Matray et al. |
| 2004/0033490 A1 | 2/2004 | Laird et al. |
| 2004/0132050 A1 | 7/2004 | Monforte |
| 2004/0146901 A1 | 7/2004 | Morris et al. |
| 2004/0170977 A1 | 9/2004 | Laird |
| 2004/0235061 A1 | 11/2004 | Wilkie et al. |
| 2004/0248172 A1 | 12/2004 | Samoszuk et al. |
| 2005/0037356 A1 | 2/2005 | Gullberg et al. |
| 2005/0064421 A1 | 3/2005 | Gehrmann |
| 2005/0142577 A1 | 6/2005 | Jones et al. |
| 2005/0250147 A1 | 11/2005 | Macevicz |
| 2005/0255482 A1 | 11/2005 | Morley |
| 2005/0260570 A1 | 11/2005 | Mao et al. |
| 2006/0019304 A1 | 1/2006 | Hardenbol et al. |
| 2006/0020397 A1 | 1/2006 | Kermani |
| 2006/0046258 A1 | 3/2006 | Lapidus |

(56) References Cited

U.S. PATENT DOCUMENTS

| | | |
|---|---|---|
| 2006/0085139 A1 | 4/2006 | Collette et al. |
| 2006/0088876 A1 | 4/2006 | Bauer |
| 2006/0134125 A1 | 6/2006 | Luxembourg et al. |
| 2006/0147925 A1 | 7/2006 | Morley et al. |
| 2006/0199210 A1 | 9/2006 | Weichselbaum et al. |
| 2006/0211030 A1 | 9/2006 | Brenner |
| 2006/0216737 A1 | 9/2006 | Bodeau |
| 2006/0228350 A1 | 10/2006 | Wu et al. |
| 2006/0233812 A1 | 10/2006 | Burnie et al. |
| 2006/0234234 A1 | 10/2006 | Van Dongen |
| 2006/0259248 A1 | 11/2006 | Collette et al. |
| 2006/0263789 A1 | 11/2006 | Kincaid |
| 2007/0020640 A1 | 1/2007 | McCloskey et al. |
| 2007/0020670 A1* | 1/2007 | Loken et al. .............. 435/6 |
| 2007/0105105 A1 | 5/2007 | Clelland |
| 2007/0117134 A1 | 5/2007 | Kou |
| 2007/0160994 A1 | 7/2007 | Lim et al. |
| 2007/0161001 A1 | 7/2007 | Leshkowitz |
| 2007/0172873 A1 | 7/2007 | Brenner et al. |
| 2007/0238099 A1 | 10/2007 | Cohen et al. |
| 2007/0243564 A1 | 10/2007 | Lawson et al. |
| 2007/0264653 A1 | 11/2007 | Berlin et al. |
| 2007/0286849 A1 | 12/2007 | Chaturvedi |
| 2008/0050780 A1 | 2/2008 | Lee et al. |
| 2008/0069770 A1 | 3/2008 | Hercend et al. |
| 2008/0108509 A1 | 5/2008 | Haupl et al. |
| 2008/0166704 A1 | 7/2008 | Marche |
| 2008/0166718 A1 | 7/2008 | Lim et al. |
| 2008/0199916 A1 | 8/2008 | Zheng et al. |
| 2008/0248484 A1 | 10/2008 | Bauer |
| 2008/0274904 A1 | 11/2008 | Gormley et al. |
| 2008/0280774 A1 | 11/2008 | Burczynski |
| 2008/0286777 A1 | 11/2008 | Candeias |
| 2009/0026082 A1 | 1/2009 | Rothberg et al. |
| 2009/0053184 A1 | 2/2009 | Morgan |
| 2009/0098555 A1 | 4/2009 | Roth et al. |
| 2009/0105959 A1 | 4/2009 | Braverman et al. |
| 2009/0181859 A1 | 7/2009 | Muraguchi |
| 2009/0197257 A1 | 8/2009 | Harris |
| 2009/0208955 A1 | 8/2009 | Robins et al. |
| 2009/0226975 A1 | 9/2009 | Sabot et al. |
| 2009/0233301 A1 | 9/2009 | Lee |
| 2009/0253581 A1 | 10/2009 | Van Eijk et al. |
| 2009/0264299 A1 | 10/2009 | Drmanac et al. |
| 2009/0280489 A1 | 11/2009 | Devinder |
| 2009/0286237 A1 | 11/2009 | Fitzgerald et al. |
| 2009/0298060 A1 | 12/2009 | Lal et al. |
| 2010/0008920 A1 | 1/2010 | Schneck et al. |
| 2010/0021894 A1 | 1/2010 | Mirkin et al. |
| 2010/0021896 A1 | 1/2010 | Han |
| 2010/0021984 A1 | 1/2010 | Edd |
| 2010/0027896 A1 | 2/2010 | Geva et al. |
| 2010/0034834 A1 | 2/2010 | Robbins et al. |
| 2010/0035764 A1 | 2/2010 | Chen |
| 2010/0040606 A1 | 2/2010 | Lantto et al. |
| 2010/0042329 A1 | 2/2010 | Hood et al. |
| 2010/0063743 A1 | 3/2010 | Gordon et al. |
| 2010/0105886 A1 | 4/2010 | Woudenberg |
| 2010/0137143 A1 | 6/2010 | Rothberg et al. |
| 2010/0151471 A1 | 6/2010 | Faham |
| 2010/0159456 A1 | 6/2010 | Albitar |
| 2010/0167353 A1 | 7/2010 | Walder et al. |
| 2010/0173394 A1 | 7/2010 | Colston, Jr. |
| 2010/0255471 A1 | 10/2010 | Clarke |
| 2010/0261204 A1 | 10/2010 | Goolsby et al. |
| 2010/0267043 A1 | 10/2010 | Braverman |
| 2010/0285975 A1 | 11/2010 | Mathies |
| 2010/0300895 A1 | 12/2010 | Nobile et al. |
| 2010/0304982 A1 | 12/2010 | Hinz et al. |
| 2010/0323348 A1 | 12/2010 | Hamady et al. |
| 2010/0330571 A1 | 12/2010 | Robins |
| 2011/0003291 A1 | 1/2011 | Pasqual |
| 2011/0014659 A1 | 1/2011 | Balazs et al. |
| 2011/0097712 A1 | 4/2011 | Cantor et al. |
| 2011/0104671 A1 | 5/2011 | Dornan et al. |
| 2011/0105343 A1 | 5/2011 | Puledran et al. |
| 2011/0129830 A1 | 6/2011 | Ladner et al. |
| 2011/0160078 A1 | 6/2011 | Fodor et al. |
| 2011/0195253 A1 | 8/2011 | Hinz et al. |
| 2011/0207134 A1 | 8/2011 | Faham |
| 2011/0207135 A1 | 8/2011 | Faham et al. |
| 2011/0207617 A1 | 8/2011 | Faham et al. |
| 2011/0223607 A1 | 9/2011 | Qu et al. |
| 2011/0251099 A1 | 10/2011 | Visvanathan et al. |
| 2012/0035062 A1 | 2/2012 | Schultz et al. |
| 2012/0058902 A1 | 3/2012 | Livingston et al. |
| 2012/0071331 A1 | 3/2012 | Casbon |
| 2012/0073667 A1 | 3/2012 | Schultz et al. |
| 2012/0122714 A1 | 5/2012 | Samuels |
| 2012/0135409 A1 | 5/2012 | Faham |
| 2012/0143531 A1 | 6/2012 | Davey et al. |
| 2012/0172241 A1 | 7/2012 | Rearick et al. |
| 2012/0173158 A1 | 7/2012 | Hubbell |
| 2012/0202710 A1* | 8/2012 | Sharma .................. C07K 16/00 506/14 |
| 2012/0220466 A1 | 8/2012 | Fire |
| 2013/0005584 A1 | 1/2013 | Faham |
| 2013/0017957 A1 | 1/2013 | Faham et al. |
| 2013/0065768 A1 | 3/2013 | Zheng |
| 2013/0116130 A1 | 5/2013 | Fu |
| 2013/0123120 A1 | 5/2013 | Zimmermann et al. |
| 2013/0136799 A1 | 5/2013 | Faham et al. |
| 2013/0150252 A1 | 6/2013 | Faham |
| 2013/0195900 A1* | 8/2013 | Dornmair ............ C12Q 1/6883 424/184.1 |
| 2013/0196328 A1 | 8/2013 | Pepin |
| 2013/0196861 A1 | 8/2013 | Quake |
| 2013/0202718 A1 | 8/2013 | Pepin |
| 2013/0236895 A1 | 9/2013 | Faham |
| 2013/0267427 A1 | 10/2013 | Faham |
| 2013/0288237 A1 | 10/2013 | Robins et al. |
| 2013/0288254 A1* | 10/2013 | Pollack ................ G01N 27/447 435/6.12 |
| 2013/0302801 A1 | 11/2013 | Asbury |
| 2013/0324422 A1 | 12/2013 | Faham et al. |
| 2013/0344066 A1 | 12/2013 | Faham |
| 2014/0057799 A1 | 2/2014 | Johnson et al. |
| 2014/0094376 A1 | 4/2014 | Han |
| 2014/0127699 A1 | 5/2014 | Han |
| 2014/0155277 A1 | 6/2014 | Wiley |
| 2014/0186848 A1 | 7/2014 | Robins et al. |
| 2014/0194295 A1 | 7/2014 | Robins et al. |
| 2014/0206548 A1 | 7/2014 | Robins et al. |
| 2014/0206549 A1 | 7/2014 | Robins et al. |
| 2014/0213463 A1 | 7/2014 | Robins et al. |
| 2014/0221220 A1 | 8/2014 | Robins et al. |
| 2014/0234835 A1 | 8/2014 | Pepin |
| 2014/0235454 A1 | 8/2014 | Faham |
| 2014/0255929 A1 | 9/2014 | Zheng |
| 2014/0255944 A1 | 9/2014 | Carlton |
| 2014/0256567 A1 | 9/2014 | Robins et al. |
| 2014/0256592 A1 | 9/2014 | Faham |
| 2014/0315725 A1 | 10/2014 | Faham et al. |
| 2014/0322716 A1 | 10/2014 | Robins |
| 2014/0336059 A1 | 11/2014 | Faham et al. |
| 2014/0342360 A1 | 11/2014 | Faham et al. |
| 2014/0342367 A1 | 11/2014 | Faham et al. |
| 2014/0349883 A1 | 11/2014 | Faham et al. |
| 2014/0356339 A1 | 12/2014 | Faham et al. |
| 2015/0017652 A1 | 1/2015 | Robins |
| 2015/0031043 A1 | 1/2015 | Faham et al. |
| 2015/0031553 A1 | 1/2015 | Faham et al. |
| 2015/0031555 A1 | 1/2015 | Johnson et al. |
| 2015/0038346 A1 | 2/2015 | Faham et al. |
| 2015/0051089 A1 | 2/2015 | Robins et al. |
| 2015/0065352 A1 | 3/2015 | Faham et al. |
| 2015/0133317 A1 | 5/2015 | Robinson et al. |
| 2015/0167080 A1 | 6/2015 | Moorhead et al. |
| 2015/0203897 A1 | 7/2015 | Robins et al. |
| 2015/0218656 A1 | 8/2015 | Kirsch et al. |
| 2015/0247182 A1 | 9/2015 | Faham et al. |
| 2015/0247198 A1 | 9/2015 | Klinger et al. |
| 2015/0247201 A1 | 9/2015 | Faham et al. |
| 2015/0252419 A1 | 9/2015 | Moorhead et al. |

(56) References Cited

U.S. PATENT DOCUMENTS

| | | |
|---|---|---|
| 2015/0252422 A1 | 9/2015 | Faham et al. |
| 2015/0259734 A1 | 9/2015 | Asbury et al. |
| 2015/0275296 A1 | 10/2015 | Klinger et al. |
| 2015/0275308 A1 | 10/2015 | Carlton et al. |
| 2015/0299785 A1 | 10/2015 | Livingston et al. |
| 2015/0299786 A1 | 10/2015 | Robins et al. |
| 2015/0299800 A1 | 10/2015 | Faham et al. |
| 2016/0115532 A1 | 4/2016 | Faham |
| 2016/0201133 A1 | 7/2016 | Faham et al. |
| 2016/0251721 A1 | 9/2016 | Robins et al. |
| 2016/0251728 A1 | 9/2016 | Faham et al. |

FOREIGN PATENT DOCUMENTS

| | | |
|---|---|---|
| EP | 0303459 A2 | 2/1989 |
| EP | 0799897 A1 | 10/1997 |
| EP | 1549764 B1 | 7/2005 |
| EP | 0972081 B1 | 6/2007 |
| EP | 1544308 B1 | 1/2009 |
| EP | 2062982 | 5/2009 |
| EP | 2088432 A1 | 8/2009 |
| EP | 2364368 B1 | 1/2014 |
| JP | 4262799 A | 9/1992 |
| JP | 2002-503954 A | 2/2001 |
| JP | 2005-245381 A | 9/2005 |
| JP | 2006-501842 A | 1/2006 |
| JP | 2007-515955 A | 6/2007 |
| JP | 2007-536939 A | 12/2007 |
| JP | 2008-099588 A | 5/2008 |
| JP | 2009-523226 A | 6/2009 |
| WO | WO 2012/083225 | 6/1920 |
| WO | WO 93/01838 A1 | 2/1993 |
| WO | WO 2005/059176 A1 | 6/1995 |
| WO | WO 95/28481 A1 | 10/1995 |
| WO | WO 97/13877 A1 | 4/1997 |
| WO | WO 97/18330 A1 | 5/1997 |
| WO | WO 97/46706 A1 | 12/1997 |
| WO | WO 98/01738 | 1/1998 |
| WO | WO 98/44151 A1 | 10/1998 |
| WO | WO 99/19717 A1 | 4/1999 |
| WO | WO 99/20798 A1 | 4/1999 |
| WO | WO 02/24322 A2 | 3/2002 |
| WO | WO 03/008624 A2 | 1/2003 |
| WO | WO 03/044225 A2 | 5/2003 |
| WO | WO 03/052101 A1 | 6/2003 |
| WO | WO 03/059155 A2 | 7/2003 |
| WO | WO 2004/003820 A2 | 1/2004 |
| WO | WO 2004/033728 A2 | 4/2004 |
| WO | WO 2004/034031 A2 | 4/2004 |
| WO | WO 2004/044209 A1 | 5/2004 |
| WO | WO 2004/046098 A2 | 6/2004 |
| WO | WO 2004/063706 A2 | 7/2004 |
| WO | WO 2004/096985 A2 | 11/2004 |
| WO | WO 2005/005651 A2 | 1/2005 |
| WO | WO 2005/042774 A2 | 5/2005 |
| WO | WO 2005/053603 A2 | 6/2005 |
| WO | WO 2005/056828 A1 | 6/2005 |
| WO | WO 2005/084134 A2 | 9/2005 |
| WO | WO 2005/111242 A2 | 11/2005 |
| WO | WO 2005/113803 A1 | 12/2005 |
| WO | WO 2006/076025 A2 | 7/2006 |
| WO | WO 2006/076205 A2 | 7/2006 |
| WO | WO 2006/110855 | 10/2006 |
| WO | WO 2006/116155 A2 | 11/2006 |
| WO | WO 2006/138284 A2 | 12/2006 |
| WO | WO 2007/008759 A2 | 1/2007 |
| WO | WO 2007/134220 A2 | 11/2007 |
| WO | WO 2008/026927 A3 | 3/2008 |
| WO | WO 2008/039694 A2 | 4/2008 |
| WO | WO 2008/108803 A2 | 9/2008 |
| WO | WO 2008/147879 A1 | 12/2008 |
| WO | WO 2009/015296 A1 | 1/2009 |
| WO | WO 2009/017678 A2 | 2/2009 |
| WO | WO 2009/019657 A2 | 2/2009 |
| WO | WO 2009/021215 A1 | 2/2009 |
| WO | WO 2009/045898 A2 | 4/2009 |
| WO | WO 2009/070767 A2 | 6/2009 |
| WO | WO 2009/095567 A2 | 8/2009 |
| WO | WO 2009/108860 A2 | 9/2009 |
| WO | WO 2009/108866 A2 | 9/2009 |
| WO | WO 2009/137255 A2 | 11/2009 |
| WO | WO 2009/137832 A2 | 11/2009 |
| WO | WO 2009/145925 A1 | 12/2009 |
| WO | WO 2009/151628 | 12/2009 |
| WO | WO 2009/158521 A2 | 12/2009 |
| WO | WO 2010/011894 A1 | 1/2010 |
| WO | WO 2010/036352 A1 | 4/2010 |
| WO | WO 2010/053587 A2 | 5/2010 |
| WO | WO 2010/151416 A1 | 12/2010 |
| WO | WO 2011/083296 A1 | 7/2011 |
| WO | WO 2011/083996 A2 | 7/2011 |
| WO | WO 2011-106738 A2 | 9/2011 |
| WO | WO 2011/107595 A1 | 9/2011 |
| WO | WO 2011/139371 | 10/2011 |
| WO | WO 2011/139372 A1 | 11/2011 |
| WO | WO 2011/140433 A2 | 11/2011 |
| WO | WO 2012/027503 | 3/2012 |
| WO | WO 2012/048340 | 4/2012 |
| WO | WO 2012/048340 A2 | 4/2012 |
| WO | WO 2012/048341 A1 | 4/2012 |
| WO | WO 2012/055929 A1 | 5/2012 |
| WO | WO 2012/061832 A1 | 5/2012 |
| WO | WO 2012/083069 | 6/2012 |
| WO | WO 2012/083225 | 6/2012 |
| WO | WO 2012/142213 A2 | 10/2012 |
| WO | WO 2012/148497 A2 | 11/2012 |
| WO | WO 2012/159754 A2 | 11/2012 |
| WO | WO 2013/033721 | 3/2013 |
| WO | WO 2013/036459 A2 | 3/2013 |
| WO | WO 2013/055595 A1 | 4/2013 |
| WO | WO 2013/059725 A1 | 4/2013 |
| WO | WO 2013/066726 A1 | 5/2013 |
| WO | WO 2013/085855 A1 | 6/2013 |
| WO | WO 2013/086450 A1 | 6/2013 |
| WO | WO 2013/086462 A1 | 6/2013 |
| WO | WO 2013/090390 A2 | 6/2013 |
| WO | WO 2013/090469 A1 | 6/2013 |
| WO | WO 2013/096480 A2 | 6/2013 |
| WO | WO 2013/130512 | 9/2013 |
| WO | WO 2013/131074 A1 | 9/2013 |
| WO | WO 2013/134162 | 9/2013 |
| WO | WO 2013/134302 | 9/2013 |
| WO | WO 2013/155119 | 10/2013 |
| WO | WO 2013/158936 | 10/2013 |
| WO | WO 2013/169957 A1 | 11/2013 |
| WO | WO 2013/181428 | 12/2013 |
| WO | WO 2013/188471 | 12/2013 |
| WO | WO 2013/188831 A1 | 12/2013 |
| WO | WO 2014/018460 | 1/2014 |
| WO | WO 2014/026031 | 2/2014 |
| WO | WO 2014/062945 | 4/2014 |
| WO | WO 2014/062959 | 4/2014 |
| WO | WO 2014/066184 | 5/2014 |
| WO | WO 2014/130685 | 8/2014 |
| WO | WO 2015/002908 A1 | 1/2015 |
| WO | WO 2015/013461 A2 | 1/2015 |
| WO | WO 2015/058159 A1 | 4/2015 |
| WO | WO 2016/138122 A1 | 9/2016 |

OTHER PUBLICATIONS

Robins et al. "Comprehensive assessment of T-cell receptor beta-chain diversity in alpha-T cells," Blood, vol. 114 (2009) pp. 4099-4107.*

Margot et al. "Primary CD20+CD10+CD8+ T-Cell Lymphoma of the Skin With Dual IgH and TCRβ Gene Rearrangement," Hematopathology, vol. 126 (2006) pp. 14-22.*

Sherwood et al. 'Deep Sequencing of the Human TCRg and TCRb Repertoires Suggests that TCRb Rearranges After ab and gd T Cell Commitment, vol. 1 (2011) pp. 1-7).*

PCT International Search Report and Written Opinion for PCT/US2013/040221, dated Sep. 23, 2013, 16 pages.

(56) References Cited

OTHER PUBLICATIONS

Henegariu, O., et al., "Multiplex PCR: Critical Parameters and Step-By-Step Protocol," Biotechniques, Informa HealthCare, Sep. 1, 1997, pp. 504-511, vol. 23, No. 3.
Larimore, K., et al., "Shaping of Human Germline IgH Repertoires Revealed by Deep Sequencing," The Journal of Immunology, Sep. 15, 2012, pp. 3221-3230, vol. 189, No. 6.
Reischl, U., et al., "Quantitative PCR A Survey of the Present Technology," Molecular Biotechnology, 1995, pp. 55-71.
Sint, D., et al., "Advances in multiplex PCR: balancing primer efficiencies and improving detection success," Methods in Ecology and Evolution, Jun. 28, 2012, pp. 898-905, vol. 3, No. 5.
Al-Lazikani, B., et al., "Standard Conformations for the Canonical Structures of Immunoglobulins," J. Mol. Biol., 1997, vol. 273, pp. 927-948.
Bahloul, M., et al., "Clinical impact of molecular diagnostics in low-grade lymphoma," Best Pract Res Clin Haematol, 2005; vol. 18, No. 1, pp. 97-111.
Bernardin et al., 'Estimate of the total number of CD8+ clonal expansions in healthy adults using a new DNA heteroduplex-tracking assay for CDR3 repertoire analysis' Journal of Immunological Methods, Mar. 1, 2003, vol. 274, No. I-2, pp. 159-175.
Berquam-Vrieze, K., et al., "Cell of origin strongly influences genetic selection in a mouse model of T-ALL," Blood, 2011, vol. 118, pp. 4646-4656.
Boyd, S., et al., "Measurement and Clinical Monitoring of Human Lymphocyte Clonality by Massively Parallel V-D-J Pyrosequencing," Science Translational Medicine, 2009, vol. 1, 12ra23, pp. 1-8.
Bradfield, SM., "Graft-versus-leukemia effect in acute lymphoblastic leukemia: the importance of tumor burden and early detection," Leukemia Mar. 25, 2004; vol. 18, pp. 1156-1158.
Campana, D., "Progress of Minimal Residual Disease Studies in Childhood Acute Leukemia," Curr Hematol Malig Rep, 2010, vol. 5, pp. 169-176.
Cave, H, et al., "Clinical Significance of minimal residual disease in childhood acute lymphoblastic leukemia," The New England Journal of Medicine, Aug. 27, 1998, vol. 339, pp. 591-598.
Chothia, C., et al., "Canonical structures for the hypervariable regions of immunoglobulins," J. Mol. Biol., 1987, vol. 196, pp. 901-917, Abstract only.
Chothia, C., et al., "Conformation of immunoglobulin hypervariable regions," Nature, Dec. 21/28, 1989, vol. 342, pp. 877-883.
Ciudad, J., et al., "Detection of abnormalities in B-cell differentiation pattern is a useful tool to predict relapse in precursor-B-ALL," British Journal of Haematology, 1999, vol. 104, pp. 695-705.
Coustan-Smith, E., et al., "Clinical importance of minimal residual disease in childhood acute lymphoblastic leukemia," Blood, Oct. 15, 2000, pp. 2691-2696, vol. 96, No. 8.
Coustan-Smith, E., et al., "Prognostic importance of measuring early clearance of leukemic cells by flow cytometry in childhood acute lymphoblastic leukemia," Blood Jul. 1, 2002; vol. 100, No. 1, pp. 52-58.
Coustan-Smith, E., et al., "Early T-cell precursor leukaemia: a subtype of very high-risk acute lymphoblastic leukaemia," Lancet Oncology, Feb. 2009, vol. 10, pp. 147-156.
Flohr, T., et al., "Minimal residual disease-directed risk stratification using real-time quantitative PCT analysis of immunoglobulin and T-cell receptor gene rearrangements in the international multicenter trial AIEOP-BFM ALL 2000 for childhood acute lymphoblastic leukemia," Leukemia, 2008, vol. 22, pp. 771-782.
Kalos, M., et al., "T Cells with Chimeric Antigen Receptors Have Potent Antitiumor Effects and Can Establish Memory in Patients with Advanced Leukemia," Sci Transl Med., 2011, vol. 3, 95ra73, pp. 1-11.
Lucio, P., et al., "Flow cytometric analysis of normal B cell differentiation: a frame of reference for the detection of minimal residual disease in precursor-B-ALL," Leukemia, 1999, pp. 419-27, vol. 13.
Monod, M.Y., et al., "IMGT/JunctionAnalysis: the first tool for the analysis of the immnoglublulin and T cell receptor complex V-J and V-D-J JUNCTIONs," Bioinformatics, 2004, vol. 20, Suppl 1, pp. i379-385.
Pohl, G., et al., "Principle and applications of digital PCR," Expert Rev. Mol. Diagn., 2004, pp. 41-47, vol. 4, No. 1.
Robin, H., et al., "Comprehensice assessment of T-cell receptor β-chain diversity in αβ T cells," Blood, Nov. 5, 2009, pp. 4099-4107, vol. 114, No. 19.
Robins, H., et al., "Overlap and Effective Size of the Human CD8+ T Cell Receptor Repertoire," Science Transitional Medicine, Sep. 1, 2010, pp. 1-9, vol. 2, Issue 47.
Robins, H., et al., "Ultra-sensitive detection of rare T cell clones," Journal of Immunological Methods, 2011, pp. 14-19, vol. 375.
Rock, E., et al., "CDR3 Length in Antigen-specific Immune Receptors," J. Exp. Med., 1994, vol. 179, pp. 323-328.
Roshal, M., et al., "Immaturity Associated Antigens Are Lost During Induction for T Cell Lymphoblastic Leukemia: Implications for Minimal Residual Disease Detection," Cytometry Part B Clin Cytom, 2010, vol. 78, pp. 139-146.
Saada, R., et al., "Models for antigen receptor gene rearrangement: CDR3 length," Immunol. Cell Biol., 2007, vol. 85, pp. 323-332.
Schrappe, M., et al., "Late MRD response determines relapse rish overall and in subsets of childhood T-cell ALL: results of the AIEOP-BFM-ALL 2000 study," Blood, Aug. 25, 2011, vol. 118, No. 8, pp. 2077-2084.
Sherwood, A., et al., "Deep Sequencing of the Human TCRγ and TCRβ Repertoires Suggests that TCR β Rearranges After αβ and γδ T Cell Commitment," Science Translational Medicine, Jul. 6, 2011, pp. 1-7, vol. 3, Issue 90.
Szczepanski, T., et al., "Minimal residual disease in leukaemea patients," The Lancet Oncology, Jul. 2001, pp. 409-417, vol. 2.
Tewhey, R., et al., "Microdroplet-based PCR enrichment for large-scale targeted sequencing," Nature Biotechnology, Nov. 2009, pp. 1025-1031, vol. 27, No. 11.
Tewhey, R., et al., "Corrigendum: Microdroplet-based PCR enrichment for large-scale targeted sequencing," Nature Biotechnology, Feb. 2010, p. 178, vol. 28, No. 2.
Van Dongen, J.J., et al., "Prognostic value of minimal residual disease in acute lymphoblastic leukaemia in childhood," The Lancet Nov. 28, 1998, vol. 352, pp. 1731-1738.
Van Der Velden, et al., "Optimization of PCT-based minimal residual disease diagnostics for childhood acute lymphoblastic leukemia in a multi-center setting," Leukemia, 2007, vol. 21, pp. 706-713.
Van Der Velden, et al., "Analysis of minimal residual disease by Ig/TCR gene rearrangements: guidelines for interpretation of real-time quantitative PCR data," Leukemia, 2007, vol. 21, pp. 604-611.
Wood, B., "9-Color and 10-Color Flow Cytometry in the Clinical Laboratory," Arch Pathol Lab Med, May 2006, vol. 130, pp. 680-690.
PCT International Search Report and Written Opinion, PCT/US2012/068617, dated Jun. 13, 2013, 10 pages.
Arstila, et al., "A Direct Estimate of the Human αβ T Cell Receptor Diversity," Science, Oct. 1999, pp. 958-961, vol. 286.
Kiianitsa, et al., "Development of tools for T cell repertoire analysis (TCRB spectratyping) for the canine model of hematopoietic cell transplantation," 49th Annual Meeting of the American Society of Hematology, Nov. 2007, p. 293B, vol. 110, No. 11.
Mariani, et al., "Comprehensive assessment of the TCRBV repertoire in small T-cell samples by means of an improved and convenient multiplex PCR method," Experimental Hematology, 2009, pp. 728-738, vol. 37, No. 6.
Maslanka, et al., "Molecular Analysis of T-Cell Repertoires: Spectratypes Generated byMultiplex Polymerase Chain Reaction and Evaluated by Radioactivity or Fluorescence", Human Technology, Apr. 1995, 44(1), 28-34.
Miqeu, P., et al., "Statistical analysis of CDR3 length distributions for the assessment of T and B cell repertoire biases," Molecular Immunology, 2007, pp. 1057-1064, vol. 44.

(56) References Cited

OTHER PUBLICATIONS

Van Dongen et al., 'Design and standardization of PCR primers and protocols for detection of clonal immunoglobulin and I-cell receptor gene recombinations in suspect lymphoproliferations: Report of the BIOMED-2 Concerted Action BMHC-CI98-3936, Leukemia, 2003, vol. 17, pp. 2257-2317.
Office Action for Canadian Patent Application No. 2,765,949, dated Apr. 3, 2014, 4 Pages.
Office Action for Chinese Patent Application No. 201080028875.2, dated Feb. 13, 2014, 9 pages.
Office Action for Israeli Patent Application No. 217200, dated Mar. 18, 2014, 8 pages.
Office Action for Russian Patent Application No. 2012101828/10(002474), dated Mar. 28, 2014, 5 pages.
Akatsuka, Y., et al., "Rapid screening of T-cell receptor (TCR) variable gene usage by multiplex PCR: Application for assessment of clonal composition," Tissue Antigens, 1999, vol. 53, pp. 122-134.
Bolotin, D., et al., "Next generation sequencing for TCR repertoire profiling: Platform-specific features and correction algorithms," Eur. J. Immunol., 2012, vol. 42, pp. 3073-3083.
de Jonge, H., et al., "Evidence Based Selection of Housekeeping Genes," PLoS One, Sep. 2007, Issue 9, e989, 5 pages.
Dheda, K., et al., "Validation of housekeeping genes for normalizing RNA expression in real-time PCR," Bio Techniques, Jul. 2004, vol. 37, pp. 112-119.
Dik, W., et al. "New insights on human T cell development by quantitative T cell receptor gene rearrangement studies and gene expression profiling," JEM, vol. 201, No. 11, Jun. 6, 2005 1715-1723.
Edwards, M.C., et al., "Multiplex PCR: advantages, development, and applications," Genome Research, 1994, vol. 3, pp. S65-S75.
Elnifro, E., et al., "Multiplex PCR: Optimization and Application in Diagnostic Virology," Clinical Microbiology Reviews, Oct. 2000, p. 559-570.
Kaplinski, L., et al., "MultiPLX Automatic Grouping and Evaluation of PCR Primers," in Methods in Molecular Biology, vol. 402: PCR Primer Design, Nov. 25, 2004, pp. 287-303.
Markoulatos, P., et al., "Multiplex Polymerase Chain Reaction: A Practical Approach," Journal of Clinical Laboratory Analysis, 2002, vol. 16, pp. 47-51.
Nicot, N., et al., "Housekeeping gene selection for real-time RT-PCR normalization in potato during biotic and abiotic stress," Journal of Experimental Botany, Nov. 2005, vol. 56, No. 421, pp. 2907-2914.
Perkel, J., "Overcoming the Challenges of Multiplex PCR," Biocompare Editorial Article, Oct. 23, 2012, 6 Pages, can be retrieved at <URL:http://www.biocompare.com/Editorial-Articles/117895-Multiplex-PCR/>.
Santalucia, J., "Physical Principles and Visual-OMP Software for Optimal PCR Design," in Methods in Molecular Biology, vol. 402: PCR Primer Design, Edited by Anton Yuryev, Aug. 23, 2007, pp. 3-33.
Silver, N., et al., "Selection of housekeeping genes for gene expression studies in human reticulocytes using real-time PCR," BMC Molecular Biology, Oct. 6, 2006, vol. 7, No. 33, pp. 1-9.
Xu, W., et al., "A Novel Universal Primer-Multiplex-PCR Method with Sequencing Gel Electrophoresis Analysis," PLoS One, vol. 7, issue 1, Jan. 2012, e22900, pp. 1-10.
Boyd, et al., "Measurement and clinical monitoring of human lymphocyte clonality by massively parallel VDJ pyrosequencing," Science Translational Medicene. 1(12):12ra23 (2009).
Rasmussen, "Quantitation of minimal residual disease in multiple myeloma using an allele-specific real-time PCR assay," Experimental Hematology, 28:1039-1045, (2000).
Van Der Velden, "Real-time quantitative PCR for detection of minimal residual disease before allogeneic stem cell transplantation predicts outcome in children with acute lymphoblastic leukemia," Leukemia, 15:1485-1487, (2001).

Van Der Velden, et al., "Detection of minimal residual disease in hematologic malignancies by real-time quantitative PCR: principles, approaches, and laboratory aspects," Leukemia, 17:1013-1034, (2003).
Freeman, et al., "Profiling the T-cell receptor beta-chain repertoire by massively parallel sequencing," Genome Res., 19:1817-1824, (2009).
Droese, et al., "Validation of BIOMED-2 multiplex PCR tubes for detection of TCRB gene rearrangements in T-cell malignancies," Leukemia, 18:1531-1538, (2004).
Casbon et al, "A method for counting PCR template molecules with application to nex-generation sequencing," Nucleic Acids Research 39(12): e81 (2011).
Craig et al, "Identification of genetic variants using bar-coded multiplex sequencing," Nature Methods, 5(10): 887-893 (2(308) and Supplemental Materials.
Eason et al, "Characterization of synthetic DNA bar codes in Saccharomyces cerevisiae acne-deletion strains," Proc. Natl. Acad. Sci., 101(30): 11046-11051 (2004).
Frank, "BARCRAWL and BARTAB: software tools for the design and implementation of barcoded primers for highly multiplexed DNA sequencing" BMC Bioinformatics, 10: 162 (Oct. 29, 2009).
Fu et al, "Counting individual DNA molecules by the stochastic attachment of diverse labels," Proc. Natl. Acad. Sci., 108(22): 9026-9031 (2011).
Gloor et al, "Microbiorne profiling by Illumina sequencing of combinatorial sequence-tagged PCR products," PLuS ONE 5(10): e15406 (2010).
Hamady, et al. Error-correcting barcoded pruners for pyrosequeneing hundreds of samples in multiplex. Nat Methods. Mar. 2008:5(3)1235-7. doi: 10.1038/nmeth.1184. Epub Feb. 10, 2008.
Hensel et al, "Simultaneous identification of bacterial virulence genes by negative selection," Science, 269(5222): 400-403 (1995).
Jabara et al, "Accurate sampling and deep sequencing of the HIV-1 protease gene using a primer ID," Proc. Natl. Acad. Sci. 108(50): 20166-20171 (2011).
Kinde et al, "Detection and quantification of mutations with massively parallel sequencing," Proc. Natl. Acad. Sci, 108: 9530-9535 (2011) and Supporting Information.
Kivioja et al, "Counting absolute numbers of molecules using unique molecular identifiers," Nature Methods, 9(1): 72-76 (2012).
Lennon et al, "A scalable, fully automated process for construction of sequence-ready barcoded libraries for 454," Genome Biology, 11 : R15 (2010).
McCloskey et al, "Encoding PCR products with batch-stamps and barcodes," Biochem. Genet., 45: 761-767 (2007).
Meyer et al, "Targeted high-throughput sequencing of tagged nucleic acid samples," Nucleic Acids Research, 35(15): e97 (2007).
Miner et al, "Molecular barcodes detect redundancy and contamination in hairpin-bisulfite PCR," Nucleic Acids Research, 32(17): e135 (2004).
Nguyen et al, "Identification of errors introduced during high throughput sequencing of the T cell receptor repertoire," BMC Genomics, 12: 106 (2011).
Parameswaran et al. "A pyrosequencing-tailored nucleotide barcode design unveils opportunities for large-scale sample multiplexing," Nucleic Acids Research, 35(19): e130 (2007).
Qiu et al, "DNA sequence-based "bar codes" for tracking the origins of expressed sequence tags from a maize cDNA library constructed using multiple mRNA sources," Plant Physiology, 133(2): 475-481 (2003).
Qu et al, "Efficient frequency-based de novo short-read clustering for error trimming in next-generation sequencing," Genome Research, 19: 1309-1315 (2009).
Robins et al, "Comprehensive assessment of T-cell receptor beta-chain diversity in alpha-beta T cells," Blood, 114(19): 4099-4107 (2009) (including supplemental materials).
Salzberg, "Mind the gaps," Nature Methods, 7(2):105-106 (2010).
Schmitt et al, "Detection of ultra-rare mutations by next-generation sequencing." Proc. Natl. Acad. Sci. 109(36): 14508-14513 (2012) and Supporting Informaton.

(56) References Cited

OTHER PUBLICATIONS

Shiroguchi et al, "Digital RNA sequencing minimizes sequence-dependent bias and amplification noise with optimized single-molecule barcodes," Proc. Natl. Acad. Sci., 109(4): 1347-1352 (2012).
Shoemaker, et al. Quantitative plienotypie analysis of yeast deletion mutants using a highly parallel molecular bar-coding strategy. Nat Genet. Dec. 14, 1996(4):450-6.
Smith et al, "Quantitative phenotyping via deep barcode sequencing" Genome Research, 19: 1836-1842 (2009).
Stiller et al., "Direct multiplex sequencing (DMPS)—a novel method for targeted high-throughput sequencing of ancient and highly degraded DNA," Genome Research, 19: 1843-1848 (2009).
Varley et al, "Nested patch PCR enables highly multiplexed mutation discovery in candidate genes," Genome Research, 18: 1844-1850 (2008).
Arstila et al, "A direct estimate of the human □β cell receptor diversity," Science, 286: 958-961 (1999).
Assaf et al, "High detection rate of T-cell receptor beta chain rearrangements in T-cell lymphoproliferations by family specific polymerase chain reaction in combination with the GeneScan technique and DNA sequencing," Blood, 96(2): 640-646 (2000).
Bentley et al, "Accurate whole human genome sequencing using reversible terminator chemistry," Nature, 456(7218); 53-59 (2008).
Bonarius et al, "Monitoring the T-cell receptor repertoire at single-clone resolution," PlosOne, 1(1): e55 (2006).
Bora et al, "Pinner sets for cloning the human repertoire of T cell receptor variable regions," BMC Immunology, 9: 50 (2008).
Boudinot et al, "New perspectives for large-scale repertoire analysis of immune receptors," Molecular Immunology, 45: 2437-2445 (2008).
Boyd et al, "Measurement and clinical monitoring of human lymphocyte clonality by massively parallel VDJ pyrosequencing," Science Transl. Med. 1(12): 12ra23 (2009)(including supplemental materials).
Buccisano et al, "Monitoring of minimal residual disease in acute myeloid leukemia," Current Opinion in Oncology, 21: 582-588 (2009).
Campbell et al, "Subclonal phylogenic structures in cancer revealed by ultra-deep sequencing," Proc. Natl. Acad. Sci. 105(35): 13081-13086 (2008).
Carlson et al, "Using synthetic templates to design an unbiased multiplex PCR," Nature Communications, 4:2680 (2013).
Compana, "Role of minimal residual disease monitoring in adult and pediatric acute lymphoblastic leukemia," Hematol. Oncol. Clin. North Am. 23(5): 1083-1098 (2009).
Decoste et al, "Relative and absolute gruantitative real-time PCR-based quantifications of hcnC and phlD gene transcripts in natural soil spiked with *Pseudomonas* sp. strain LBUM300," Applied Environmental Microbiol., 77(1): 41-47 (2011).
Dohm et al, "Substantial biases in ultra-short read data sets from high-throughput DNA sequencing." Nucleic Acids Research, 36(16): e105 (2008).
Freeman et al, "Profiling the T-cell receptor beta-chain repertoire by massively parallel sequencing," Genome Research, 19(10): 1817-1824(2009).
Garcia-Castillo et al, "Detection of clonal immunoglobulin and T-cell receptor gene recombination in hematological malignancies: monitoring minimal residual disease," Cardiovascular & Haematological Disorders-Drug Targets, 9: 124-135 (2009).
Gonzalez et al. "Incomplete DJH rearrangements as a novel tumor target for minimal residual disease quantitation in multiple myeloma using real-time PCR," Leukemia, 17: 1051-1057 (2003).
Gonzalez et al, "Incomplete DJH rearrangements of the IgH gene are frequent in multiple myeloma patients: immunobiological characteristics and clinical applications," Leukemia, 17: 1398-1403 (2003).

Han, et al. "Immunorepertoire analysis by multiplex PCR amplification and high throughput sequencing," Abstract. The 96 Annual Meeting of the American Association of Immunologists, Seattle, Washington, May 8-12, 2009.
Harris et al, "Single-molecule DNA sequencing of a viral genome," Science, 320: 106-109 (2008).
Huse et al, "Accuracy and quality of massively parallel DNA pyrosequencing," Genome Biology, 8: R143 (2007).
Illumina Technical Note, "Calling sequencing SNPs," (2010).
Kato et al, "Analysis of accumulated T cell clonotypes in patients with systemic lupus erythematosus," Arthritis & Rheumatism, 43(12): 2712-2721 (2000).
Kim et al, "Polony multiplex analysis of gene expression (PMAGE) in mouse hypertrophic cardiomyopathy," Science, 316: 1481-1484 (2007)(including supplemental materials).
Kneba et al, "Analysis of rearranged T-cell receptor β-chain genes by polymer ase chain reaction (PCR) DNA sequencing and automated high resolution PCR fragment analysis," Blood, 86: 3930-3937 (1995).
Li et al, "Sequence analysis of clonal immunogiohulin and T-cell receptor gene rearrangements in children with acute lymphoblastic leukemia at diagnosis and at relapse: implications for pathogenesis and for the clinical utility of PCR-based methods of minimal residual disease detection,"Blood, 102:4520-4526 (2003).
Margulies et al, "Genome sequencing in microfabricated high-density picoliter reactors," Nature, 437: 376-380 (2005).
Muraro et al, "Molecular tracking of antigen-specific T cell clones in neurological immune-mediated disorders," Brain, 126: 20-31 (2003).
Ogle et al, "Direct measurement of lymphocyte receptor dhiersity," Nucleic Acids Research, 31 (22): e139 (2003).
Packer et al, "Optimized clonotypic analysis of T-cell receptor repertoire in immune reconstitution," Experimental Hematology, 35: 516-521 (2007).
Plasilova et al, "Application of the molecular analysis of the T-cell receptor repertoire in the study of immune-mediated hematologic diseases," Hematology, 8(3): 173-181 (2003).
Polz et al, "Bias in template-to-product ratios in multitemplate PCR" Applied and Environmental Microbiology. 64(10): 3724-3730 (1998).
Qu et al, "Efficient frequency-based de novo short-read clustering for error trimming in next generation sequencing," Genome Research, 19: 1309-1315 (2009).
Quince et al, "Removing noise from pyrosequenced amplicons," BMC Bioinformatics, 12: 38 (2011).
Reinartz, et al, "Massively parallel signature sequencing (MPSS) as a tool for in-depth quantitative gene expression profiling in all organisms," Briefings in Functional Genomics and Proteomics, 1(1): 95-104 (Feb. 2002).
Robins et al, "Comprehensive assessment of T-cell receptor β chain diversity in □βT cells," Blood, 114(1): 4099-4107 (2009)(including supplemental materials).
Robins et al, "Overlap and effective size of the human CD8+ T cell receptor repertoire," Science Translational Medicine, 2(47): 47ra64 (Sep. 1, 2010).
Shendure et al, "Next-generation DNA sequencing," Nature Biotechnology 26(10): 1135-1145 (2008).
Sing et al, "A molecular comparison of T lymphocyte populations infiltrating liver and circulating in the blood of patients with chronic hepatitis B: evidence for antigen-driven selection of a public complementary-determining region 3 (CDR3) motif," Hepatology. 33(5): 1288-1298 (2001).
Sint et al, "Advances in multiplex PCR: balancing primer efficiencies and improving detection success," Methods in Ecology and Evolution 3: 898-905 (2012).
Szczepanski et al, "Comparative analysis of Ig and TCR gene rearrangements at diagnosis and at relapse of childhood precursor-B-ALL provides improved strategies for selection of stable PCR targets for monitoring of minimal residual disease," Blood, 99(7): 2315-2323 (2002).

(56) References Cited

OTHER PUBLICATIONS

Van Do Gen et al, "Design and standardization of PCR primers and protocols for detection of clonal immunoglobulin and T-cell receptor gene recombinations in suspect lymphoproliferations: Report of the BIOMED-2 concerted action BMH4-CT98-3936," Leukemia, 17: 2257-2317 (2003).
Wang, et al. High throughput sequencing reveals a complex pattern of dynamic interrelationships among human T cell subsets. Proc Natl Acad Sci USA, Jan. 26, 2010: 107(4): 1518-1523.
Warren et al, "Profiling model T-cell metagenomes with short reads," Bioinformatics, 25(4): 458-464 (2009).
Warren et al, "Exhaustive T-cell repertoire sequencing of human peripheral blood samples reveals signatures of antigen selection and a directly measured repertoire size of at least 1 million clonotypes," Genome Research, 21: 790-797 (2011).
Weinstein et al, "High throughput sequencing of the zebrafish antibody repertoire," Science, 324: 807-810 (2009).
Wlodarski et al. "Pathologic clonal cytotoxic T-cell responses: nonrandom nature of the T-cell-receptor restriction in large granular lymphocyte Leukemia," Blood, 106: 2769-2779 (2005).
Wlodarski et al, "Molecular strategies for detection and quantitation of clonal cytotoxic T-cell responsses in aplastic anemia and myclodysplastic syndrome," Blood, 108: 2632-2641 (2006).
Zhou et al, "High throughput analysis of TCR-β rearrangement and gene expression in single cells," Laboratory Investigation, 86: 314-321 (2006).
Sandberg et al. "BIOMED-2 Multiplex Immunoglobulin/T-Cell Receptor Polymerase Chain Reaction Protocols Can Reliably Replace Southern Blot Analysis in Routine Clonality Diagnostics", *J. Molecular Diagnostics*, 7(4): 495-503 (2005).
Zehentner et al. "Minimal Disease Detection and Confirmation in Hematologic Malignancies: Combining Cell Sorting with Clonality Profiling",*Clinical Chemistry*, 52(3): 430-437 (2006).
Abath et al. "Single-tubed nested PCR using immobilized internal primers", *Biotechniques*, 33(6): 1210-2, 1214 (2002).
Abbott, et al. "Design and use of signature primers to detect carry-over of amplified material", *J Virol Methods*, 46(1):51-59, Abstract Only (1994).
Ahmadzadeh et al. "FOXP3 expression accurately defines the population of intratumoral regulatory T cells that selectively accumulate in metastatic melanoma lesions", *Blood*, 112(13): 4953-4960 (2008).
Alatrakchi et al. "T-cell clonal expansion in patients with B-cell lymphoproliferative disorders", *Journal of Immunotherapy*, 21(5):363-370 (1998).
Alexandre, D. et al. "*H. sapiens* rearranged T-cell receptor gamma chain gene, V2-JP1", GenBank accession No: X57737, NCBI, Nov. 14, 2006, 8 pages [online] [retrieved on Jun. 26, 2013] Retrieved from the internet <URL:http://www.ncbi.nlm.nih.gov/nuccore/x57737>.
Alexandre, D. et al. "*H. sapiens* rearranged T-cell receptor gamma chain gene, V3RS-J1 (hybrid joint)", GenBank accession No: X57740, NCBI, Feb. 11, 1997, 8 pages [online] [retrieved on Jun. 26, 2013] Retrieved from the internet <URL:http://www.ncbi.nlm.nih.gov/nuccore/x57740>.
Altin et al. "The role of CD45 and CD45-associated molecules in T cell activation", *Immunology and Cell Biology*, 75: 430-445 (1997).
Altman, et al. "Phenotypic analysis of antigen-specific T lymphocytes", The *Journal of Immunology*, 187(1):7-9 (2011).
Altschul, et al. "Basic local alignment search tool", *J Mol Biol.*, 215(3):403-410 (1990).
Andreasson, et al. "The human IgE-encoding transcriptome to assess antibody repertoires and repertoire evolution", *J Mol Biol.*, 362(2):212-227 (2006). Epub Aug. 14, 2006.
Arnaout. "Specificity and overlap in gene segment-defined antibody repertoires", *BMC Genomics*, 6: 148 (2005).
Arden, et al. "Human T-cell receptor variable gene segment families", *Immunogenetics*, 42(6):455-500, Abstract Only (1995).

Armand, P. et al., "Detection of circulating tumour DNA in patients with aggressive B-cell non-Hodgkin lymphoma", *Brit. J. Haematol.*, vol. 163, pp. 123-126 (2013).
Aarts et al., "Variable heavy-chain gene analysis of follicular lymphomas: subclone selection rather than clonal evolution over time", Blood, 98(1): 238-240 (2001).
Aslanzadeh. "Preventing PCR amplification carryover contamination in a clinical laboratory", *Ann Clin Lab Sci*., 34(4):389-396 (2004).
Ateya, et al. "The good, the bad, and the tiny: a review of microflow cytometry", *Anal Bioanal Chem*., 391(5): 1485-1498 (2008). doi: 10.1007/s00216-007-1827-5. Epub Jan. 29, 2008.
Babrzadeh et al. "Development on High-throughput Sequencing Technology: emPCR Titration and Barcode Design", *Stanford School of Medicine*, 2 pages (2011).
Bagnara, et al. "IgV gene intraclonal diversification and clonal evolution in B-cell chronic lymphocytic leukaemia", *British Journal of Haematology*, 133(1):50-58 (2006).
Bajor et al., "Immune activation and a 9-year ongoing complete remission following CD40 antibody therapy and metastasectomy in a patient with metastatic melanoma", Cancer Immunol Res., 2(11): 1051-1058 (2014).
Baldauf, "Phylogeny for the faint of heart: a tutorial," Trends in Genetics, 19(6): 345-351 (2003).
Barbas, et al. "Assembly of combinatorial antibody libraries on phage surfaces: the gene III site", *PNAS*, 88(18): 7978-7982, Abstract Only (1991).
Barker, et al. "A second type II restriction endonuclease from Thermus aquaticus with an unusual sequence specificity", *Nucleic Acids Res*., 12(14): 5567-5581 (1984).
Batzoglou, S. "The many faces of sequence alignment", *Briefings in Bioinformatics*, 6:6-22 (2005).
Baum and McCune et al. "Direct measurement of T-cell receptor repertoire diversity with AmpliCot", *Nat Methods*, 3(11): 895-901 (2006).
Becattini et al., "T cell immunity. Functional heterogeneity of human memory CD4+ T cell clones primed by pathogens or vaccines", Science, 347(6220): 400-406 (2015).
Becker-André and Hahlbrock. "Absolute mRNA quantification using the polymerase chain reaction (PCR). A novel approach by a PCR aided transcript titration assay (PATTY)", *Nucleic Acids Res*., 17(22): 94379446 (1989).
Becton-Dickinson, CD marker handbook. bdbiosciences.com/go/mousecdmarkers, p. 1-47 (2010).
Becton-Dickinson T-Cell Research Tools, "Novel multicolor flow cytometry tools for the study of CD4+ T-cell differentiation and plasticity", 16 pages (2009).
Beishuizen, et al. "Analysis of Ig and T-cell receptor genes in 40 childhood acute lymphoblastic leukemias at diagnosis and subsequent relapse: implications for the detection of minimal residual disease by polymerase chain reaction analysis", *Blood*, 83(8):2238-2247 (1994).
Ben-Ezra, et al. Effect of fixation on the amplification of nucleic acids from paraffin-embedded material by the polymerase chain reaction, *The Journal of Histochemistry and Cytochemistry*, 39(3): 351-354 (1991).
Béné and Kaeda, "How and why minimal residual disease studies are necessary in leukemia: a review from WP10 and WP12 of the European LeukaemiaNet", *Haematologica*, 94(8):1135-1150 (2009).
Benecke. "DNA typing in forensic medicine and in criminal investigations: a current survey", *Naturwissenschaften*, 84(5): 181-188 (1997).
Benichou, J. et al., "Rep-Seq: uncovering the immunological repertoire through next-generation sequencing", *Immunology*, 135(3): 183-191 (2011).
Benichou, J. et al., "The restricted DH gene reading frame usage in the expressed human antibody repertoire is selected based upon its amino acid content", J Immunol., 190(11): 5567-77, 29 pages (2013).

(56) References Cited

OTHER PUBLICATIONS

Bereczki, et al. "Optimization of PCR amplification for B- and T-cell clonality analysis on formalin-fixed and paraffin-embedded samples", *Pathology Oncology Research*, 13(3): 209-214 (2007). Epub Oct. 7, 2007.

Berger, et al. "The clonotypic T cell receptor is a source of tumor-associated antigens in cutaneous T cell lymphoma", *Annals of the New York Academy of Sciences*, 941:106-122, Abstract Only (2001).

Berget, et al. "Detection of clonality in follicular lymphoma using formalin-fixed, paraffin-embedded tissue samples and BIOMED-2 immunoglobulin primers", J Clin Pathol., 64(1):37-41 (2011). doi: 10.1136/jcp.2010.081109. Epub Oct. 28, 2010.

Berglund et al., "Genomic imbalances during transformation from follicular lymphoma to diffuse large B-cell lymphoma", Modern Pathology, 20(1): 63-75 (2007).

Bernard et al. "Color multiplexing hybridization probes using the apolipoprotein E locus as a model system for genotyping", Anal Biochem., 273(2):221-228 (1999).

Bertness, et al. "T-Cell Receptor Gene Rearrangements as Clinical Markers of Human T-Cell Lymphomas", *The New England Journal of Medicine*, 313:534-538 (1985).

Bettini et al., "Membrane association of the CD3ε signaling domain is required for optimal T cell development and function", J Immunol., 193(1): 258-267 (2014).

Berzofsky, et al. "Progress on new vaccine strategies for the immunotherapy and prevention of cancer", *J Clin Invest.*, 113(11): 1515-1525 (2004).

Biagi, et al. "Responses to human CD40 ligand/human interleukin-2 autologous cell vaccine in patients with B-cell chronic lymphocytic leukemia", *Clin Cancer Res.*, 11(19 Pt 1): 6916-6923 (2005).

Biggerstaff, et al. "Enumeration of leukocyte infiltration in solid tumors by confocal laser scanning microscopy", *BMC Immunol.*, 7:16, 13 pages (2006).

Blow, N., "PCR's next frontier," *Nature Methods*, 4(10):869-875 (2007).

Brochet et al. "IMGTN-QUEST: the highly customized and integrated system for IG and TR standardized V-J and V-D-J sequence analysis", *Nucleic Acids Research*, vol. 36, Web Server issue W503-W508 (2008).

Bonner et al. "Fluorescence activated cell sorting", Rev Sci Instrum., 43(3):404-409, Abstract Only (1972).

Borst, et al. "False-positive results and contamination in nucleic acid amplification assays: suggestions for a prevent and destroy strategy", Eur J Clin Microbiol Infect Dis., 23(4):289-299, Abstract Only (2004). Epub Mar. 10, 2004.

Bousso. "Generation of MHC-peptide tetramers: a new opportunity for dissecting T-cell immune responses", Microbes Infect., 2(4):425-429, Abstract Only (2000).

Boyce, et al. "Human regulatory T-cell isolation and measurement of function", *BD Biosciences*, pp. 1-20 (2010).

Boyd, S.D. et al., "Individual Variation in the Germline Ig Gene Repertoire Inferred from Variable Region Gene Rearrangements", *The Journal of Immunology*, 184(12): 6986-6992 (2010).

Bravo and Irizarry. "Model-Based Quality Assessment and Base-Calling for Second-Generation Sequencing Data", Biometrics, 66(3): 665-674 (2010).

Brehm-Stecher and Johnson. "Single-cell microbiology: tools, technologies, and applications", *Microbiology and Molecular Biology Reviews*, 68(3):538-559 (2004).

Brenan, C. et al., "High throughput, nanoliter quantitative PCR," *Drug Discovery Today: Technologies*, 2(3):247-253 (2005).

Brenner, et al. "In vitro cloning of complex mixtures of DNA on microbeads: physical separation of differentially expressed cDNAs", *PNAS*, 97(4): 1665-1670 (2000).

Brentjens, et al. "CD19-targeted T cells rapidly induce molecular remissions in adults with chemotherapy- refractory acute lymphoblastic leukemia", Sci Transl Med., 5(177): 177ra38 (2013). doi: 10.1126/scitranslmed.3005930.

Brisco, et al. "Determining the repertoire of IGH gene rearrangements to develop molecular markers for minimal residual disease in B-lineage acute lymphoblastic leukemia", *J Mol Diagn.*, 11(3):194-200 (2009).

Brisco, et al. "Outcome prediction in childhood acute lymphoblastic leukaemia by molecular quantification of residual disease at the end of induction", *Lancet*, 343:196-200 (1994).

Brockman et al, "Quality scores and SNP detection in sequencing-by-synthesis systems," Genome Research, 18: 763-770 (2008).

Brody, et al. "Active and passive immunotherapy for lymphoma: proving principles and improving results", J Clin Oncol., 29(14):1864-1875, Abstract Only (2011). doi: 10.1200/JCO.2010. 33.4623. Epub Apr. 11, 2011.

Brody, et al., "Immunotransplant for mantle cell lymphoma: Phase I/II study preliminary results", *Journal of Clinical Oncology*, ASCO Annual Meeting Abstracts Part 1, vol. 29, No. 15, 1 page (2011).

Brody, et al. "Lymphoma immunotherapy: vaccines, adoptive cell transfer and immunotransplant", *Immunotherapy*, 1(5): 809-824 (2009). doi: 10.2217/imt.09.50.

Brown, et al. "Current techniques for single-cell lysis", *J. R. Soc. Interface*, 5:S131-S138 (2008).

Brownie et al. "The elimination of primer-dimer accumulation in PCR", Nucleic Acids Research, 25(16): 3235-3241 (1997).

Brüggemann, et al. "Clinical significance of minimal residual disease quantification in adult patients with standard-risk acute lymphoblastic leukemia", Blood, 107(3):1116-1123 (2006). Epub Sep. 29, 2005.

Brüggemann, et al. "Rearranged T-cell receptor beta genes represent powerful targets for quantification of minimal residual disease in childhood and adult T-cell acute lymphoblastic leukemia", Leukemia, 18(4): 709-719 (2004).

Brüggemann, et al. "Standardized MRD quantification in European ALL trials: proceedings of the Second International Symposium on MRD assessment in Kiel, Germany, Sep. 18-20, 2008", *Leukemia*, 24(3):521-535 (2010). doi: 10.1038/leu.2009.268. Epub Dec. 24, 2009.

Buck, G.A. et al. "Design Strategies and Performance of Custom DNA Sequencing Primers", *Biotechniques*, 27(3):528-536 (1999).

Buccisano, et al. "Prognostic and therapeutic implications of minimal residual disease detection in acute myeloid leukemia", Blood, 119(2):332-341 (2012). doi: 10.1182/blood-2011-08-363291. Epub Oct. 28, 2011.

Butkus, B. "Hutch Team Uses ddPCR to Quantify T-Cell Response in Tumors; Adaptive Biotech Eyes Market", *PCR Insider*, Dec. 12, 2013, 3 pages http://www.genomeweb.com/print/1323296.

Bystrykh. "Generalized DNA Barcode Design Based on Hamming Codes", *PLoS ONE*, 7(5): e36852, 1-8 (2012).

Campana. "Minimal residual disease in acute lymphoblastic leukemia", *Semin Hematol.*,46(1):100-106 (2009).

Caporaso, J.G. et al. "Global patterns of 16S rRNA diversity at a depth of millions of sequences per sample", *PNAS*, 108(Suppl. 1):4516-4522 (2010).

Carlotti, et al. "Transformation of follicular lymphoma to diffuse large B-cell lymphoma may occur by divergent evolution from a common progenitor cell or by direct evolution from the follicular lymphoma clone", *Blood*, 113(15): 3553-3557 (2009). doi: 10.1182/blood-2008-08-174839. Epub Feb. 6, 2009.

Carlson et al. "Profiling the repertoire of TCRB usage in induced and natural Treg cells", *The Journal of Immunology*, 186: 62.5, Abstract (2011).

Carlson, et al. "Immune Profiling Suggests an IGH Signaling-Dependent Subtype of Aggressive B-ALL", *Blood*, 120: 1428, Abstract (2012).

Carlson, et al. "Deep sequencing of the human TCRγ and TCRβ repertoires provides evidence that TCRβ rearranges after αβ, γδT cell commitment". Presented at the ASHG 2011 Conference. Oct. 2011. Poster. 1 page.

Carlson, et al. "Detection of tumor tagging clones in multiple myeloma via high throughput sequencing is robust to significant levels of SHM", Presented for the 2014 ASH Annual Meeting. Poster. 1 page. Dec. 5-9, 2014.

(56) References Cited

OTHER PUBLICATIONS

Casali, et al. "Human monoclonals from antigen-specific selection of B lymphocytes and transformation by EBV", *Science*, 234(4775): 476-479, Abstract Only (1986).

Catherwood, M.A. et al., "Improved clonality assessment in germinal centre/post germinal centre non-Hodgkin's lymphomas with high rates of somatic hypermutation", *J. Clin. Pathol.*, 60:524-528, Abstract (2007).

Chan et al. "Evaluation of Nanofluidics Technology for High-Throughput SNP Genotyping in a Clinical Setting", *The Journal of Molecular Diagnostics*, 13(3): 305-312 (2011).

Chattopadhyay, et al. "A live-cell assay to detect antigen-specific CD4+ T cells with diverse cytokine profiles", *Nat Med.*, 11(10): 1113-1117 (2005). Epub Sep. 25, 2005.

Chen et al. "A novel approach for the analysis of T-cell reconstitution by using a T-cell receptor β-based oligonucleotide microarray in hematopoietic stem cell transplantation", *Exp Hematol.*, 35(5):831-841 (2007).

Chen et al. "Identification of racehorse and sample contamination by novel 24-plex STR system", Forensic Science International: Genetics, 4:158-167 (2010).

Chen, et al. "Microfluidic cell sorter with integrated piezoelectric actuator", *Biomed Microdevices*, 11(6): 1223-1231 (2009). doi: 10.1007/s10544-009-9341-5.

Chen, Y. et al., "T-cell receptor gene expression in tumour-infiltrating lymphocytes and peripheral blood lymphocytes of patients with nasopharyngeal carcinoma", *British Journal of Cancer*, 72(1): 117-22 (1995).

Chen, et al. "Total Gene Synthesis: Novel Single-Step and Convergent Strategies Applied to the Construction of a 779 Base Pair Bacteriorhodopsis", *Gene. J. Am. Chem Soc.*, 116: 8799-8800, Abstract Only (1994).

Chiu, et al. "Non-invasive prenatal assessment of trisomy 21 by multiplexed maternal plasma DNA sequencing: large scale validity study", *BMJ*, 342:c7401, 9 pages (2011). doi: 10.1136/bmj.c7401.

Choi, et al. "Relapse in children with acute lymphoblastic leukemia involving selection of a preexisting drug-resistant subclone", *Blood*, 110(2):632-639 (2007).

Choi, et al. "Clonal evolution in B-lineage acute lymphoblastic leukemia by contemporaneous $V_H$-$V_H$ gene replacements and $V_H$-$DJ_H$ gene rearrangements", *Blood*, 87(6):2506-2512 (1996).

Churchill and Waterman. "The Accuracy of DNA Sequences: Estimating Sequence Quality", *Genomics*, 14:89-98 (1992).

Chute, et al. "Detection of immunoglobulin heavy chain gene rearrangements in classic Hodgkin lymphoma using commercially available BIOMED-2 primers", *Diagn Mol Pathol.*, 17(2): 65-72 (2008). doi: 10.1097/Pdm.0b013e318150d695.

Citri et al. "Comprehensive qPCR profiling of gene expression in single neuronal cells", *Nature Protocols*, 7(1): 118-127 (2012).

Cleary, et al. "Production of complex nucleic acid libraries using highly parallel in situ oligonucleotide synthesis", *Nat Methods*, 1(3): 241-248 (2004). Epub Nov. 18, 2004.

Clemente, et al. "Deep sequencing of the T-cell receptor repertoire in CD8+ T-large granular lymphocyte leukemia identifies signature landscapes", Blood, 122(25): 4077-85 (2013). doi: 10.1182/blood-2013-05-506386. Epub Oct. 22, 2013.

Conti et al. "Oral-resident natural Th17 cells and γδ T cells control opportunistic Candida albicans infections", J Exp Med., 211(10): 2075-84 (2014). doi: 10.1084/jem.20130877. Epub Sep. 8, 2014.

Cooper, et al. "BRAF inhibition is associated with increased clonality in tumorin filtrating lymphocytes", *Oncoimmunology*, 2(10):e26615 (2013). Epub Oct. 15, 2013.

Costabile, et al. "Molecular approaches in the diagnosis of primary immunodeficiency diseases", *Human Mutation*, 27(12):1163-1173 (2006).

Cronin, et al. "Comprehensive next-generation cancer genome sequencing in the era of targeted therapy and personalized oncology", *Biomark Med.*, 5(3):293-305 (2011). (Abstract only). doi: 10.2217/bmm.11.37.

Cronn et al. "Multiplex sequencing of plant chloroplast genomes using Solexa sequencing-by-synthesis technology", *Nucleic Acids Research*, 36(19):e122, 1-11 (2008).

Curran et al. "Nucleotide sequencing of psoriatic arthritis tissue before and during methotrexate administration reveals a complex inflammatory T cell infiltrate with very few clones exhibiting features that suggest they drive the inflammatory process by recognizing autoantigens", *The Journal of Immunology*, 172:1935-1944 (2004).

Curran-Everett, D., "Multiple comparisons: philosophies and illustrations", *Am J Physiol Regulatory Integrative Comp Physiol.*, 279:R1-R8 (2000).

Currier and Robinson. "Spectratype/immunoscope analysis of the expressed TCR repertoire", *Current Protocols in Immunology*, Supplement 38:10.28.1-10.28.24 (2000).

Dahl et al. "Multiplex amplification enabled by selective circularization of large sets of genomic DNA fragments", Nucleic Acids Res., 33(8): e71 (2005).

Damle et al. "B-cell chronic lymphocytic leukemia cells express a surface membrane phenotype of activated, antigen-experienced B lymphocytes", *Blood*, 99(11): 4087-93 (2002).

Dash, P. et al., "Paired analysis of TCR[alpha] and TCR[beta] chains at the single-cell level in mice", *Journal of Clinical Investigation*, 121(1):288-295 (2011).

Davi, et al. "Lymphocytic progenitor cell origin and clonal evolution of human B-lineage acute lymphoblastic leukemia", *Blood*, 88(2):609-621 (1996).

Davila, et al. Efficacy and toxicity management of 19-28z CART cell therapy in B cell acute lymphoblastic leukemia, Sci Transl Med., 6(224):224ra25 (2014). doi: 10.1126/scitranslmed.3008226.

Davis, et al. "Interrogating the repertoire: broadening the scope of peptide-MHC multimer analysis", *Nat Rev Immunol.*, 11(8):551-558 (2011). doi: 10.1038/nri3020.

Davis, et al. "Staining of cell surface human CD4 with 2'-F-pyrimidine-containing RNA aptamers for flow cytometry", *Nucleic Acids Research*, 26(17):3915-3924 (1998).

De Bona et al. "Optimal spliced alignments of short sequence reads", *Bioinformatics*, 9(Suppl 10):07, 2 pages (2008).

de Haas et al., "Quantification of minimal residual disease in children with oligoclonal B-precursor acute lymphoblastic leukemia indicates that the clones that grow out during relapse already have the slowest rate of reduction during induction therapy", Leukemia, 15: 134-140 (2001).

Dean, et al. "Rapid amplification of plasmid and phage DNA using Phi 29 DNA polymerase and multiply-primed rolling circle amplification", *Genome Res.*, 11(6): 1095-1099 (2001).

Dedhia, et al. "Evaluation of DNA extraction methods and real time PCR optimization on formalin-fixed paraffin-embedded tissues", *Asian Pac J Cancer Prev.*, 8(1): 55-59 (2007).

Deiman, et al. "Characteristics and applications of nucleic acid sequence-based amplification (NASBA)", *Mol Biotechnol.*, 20(2): 163-179, Abstract Only (2002).

DeKosky et al. "High-throughput sequencing of the paired human immunoglobulin heavy and light chain repertoire", *Nature Biotechnology*, 31(2): 166-169 (2013).

Delaney, et al. "Evolution and Clinical Implications of the T cell Repertoire Following Cord Blood Transplant", Biology of Blood and Marrow Transplant, vol. 19, Issue 2, S201-S202. Published Feb. 2013.

Deng et al. "Gene profiling involved in immature CD4+ T lymphocyte responsible for systemic lupus erythematosus", *Molecular Immunology*, 43:1497-1507 (2006).

DeNucci, C.C. et al. "Integrin function in T-cell homing to lymphoid and nonlymphoid sites: getting there and staying there," *Critical Reviews in Immunology*, 29(2):87-109 (2009).

Deschoolmeester, et al. "Tumor infiltrating lymphocytes: an intriguing player in the survival of colorectal cancer patients", *BMC Immunology*, 11:19, 12 pages (2010). doi: 10.1186/1471-2172-11-19.

Desmarais, et al. "Deep profiling of the mouse TCRβ CDR3 region in thymus and spleen". Oct. 2010. Poster. 1 page.

Desmarais, et al. High-throughput sequencing of memory and naïve T cell receptor repertoires at the RNA and DNA levels reveals

(56) References Cited

OTHER PUBLICATIONS differences in relative expression of expanded TCR clones. Adaptive Technologies. Seattle W A. Poster, 1 page. Presented May 5, 2012.
Desmarais and Robins. "High-throughput sequencing of memory and naïve T cell receptor repertoires at the RNA and DNA levels reveals differences in relative expression of expanded TCR clones", The Journal of Immunology, 188: 178.12 (2012).
Dictor et al. "Resolving T-cell receptor clonality in two and genotype in four multiplex polymerase chain reactions", *Haematologica*, 90(11): 1524-1532 (2005).
Diederichsen, et al. "Prognostic value of the CD4+/CD8-30 ratio of tumour infiltrating lymphocytes in colorectal cancer and HLA-DR expression on tumour cells", *Cancer Immunol Immunother.*, 52(7):423-428 (2003). Epub Apr. 15, 2003.
Diehl, et al. "BEAMing: single-molecule PCR on microparticles in water-in-oil emulsions", *Nat Methods*, 3(7):551-559, Abstract Only (2006).
Diluvio et al. "Identical TCRβ-chain rearrangements in streptococcal angina and skin lesions of patients with psoriasis vulgaris", *J Immunol.*, 176(11 ): 7104-11 (2006).
Ding, et al. "Clonal evolution in relapsed acute myeloid leukaemia revealed by whole-genome sequencing", *Nature*, 481(7382):506-510 (2012). doi: 10.1038/nature10738.
Diviacco, et al. "A novel procedure for quantitative polymerase chain reaction by coamplification of competitive templates", *Gene*, 122(2):313-320 (1992).
Do and Batzoglou. "What is the expectation maximization algorithm?", *Nature Biotechnology*, 26(8): 897-899 (2008).
Dobosy, J. et al. "RNase H-dependent PCR (rhPCR): improved specificity and single nucleotide polymorphism detection using blocked cleavable primers", *BMC Biotechnology*, 11(80):1-18 (2011).
Dou, et al. "Analysis of T cell receptor $V_β$ gene usage during the course of disease in patients with chronic hepatitis B", *Journal of Biomedical Science*, 5(6):428-434 (1998).
Dressman, et al. "Transforming single DNA molecules into fluorescent magnetic particles for detection and enumeration of genetic variations", PNAS, 100(15):8817-8822 (2003). Epub Jul. 11, 2003.
Drmanac, et al. "Human genome sequencing using unchained base reads on self-assembling DNA nanoarrays", *Science*, 327(5961):78-81 (2010). doi: 10.1126/science.1181498. Epub Nov. 5, 2009.
Droege, et al. "The Genome Sequencer FLX System—longer reads, more applications, straight forward bioinformatics and more complete data sets", *J Biotechnol.*, 136(1-2):3-10 (2008). doi: 10.1016/j.jbiotec.2008.03.021. Epub Jun. 21, 2008.
Drossman, et al. "High-speed separations of DNA sequencing reactions by capillary electrophoresis", *Anal Chem.*, 62(9): 900-903 (1990).
Du et al. "TCR spectratyping revealed T lymphocytes associated with graft-versus-host disease after allogeneic hematopoietic stem cell transplantation", *Leukemia & Lymphoma*, 48(8):1618-1627 (2007).
Duby, A.D. et al., "Human T-cell receptor aberrantly rearranged beta-chain J1.5-Dx-J2.1 gene," PNAS, GenBank accession No. M13574.1, bases 1 to 100, 4 pages (1986).
Dudgeon, et al. "The evolution of thymic lymphomas in p53 knockout mice", Genes Dev., 28(23): 2613-20 (2014). doi: 10.1101/gad.252148.114.
Dunn, et al. "Focus on TILs: Prognostic significance of tumor infiltrating lymphocytes in human glioma", *Cancer Immun.*, 7:12, 16 pages (2007).
Edd et al. "Controlled encapsulation of single cells into monodisperse picoliter drops", *Lab Chip*, 8(8):1262-1264 (2008).
Eichler, et al. "Haplotype and interspersion analysis of the FMR1 CGG repeat identifies two different mutational pathways for the origin of the fragile X syndrome", *Hum Mol Genet.*, 5(3):319-330 (1996).
Eichler, et al. "Length of uninterrupted Cgg repeats determines instability in the FMR1 gene", *Nat Genet.*, 8(1):88-94, Abstract Only (1994).
Eid et al. "Real-time DNA sequencing from single polymerase molecules", *Science*, 323(5910):133-138 (2009). doi: 10.1126/science.1162986. Epub Nov. 20, 2008.
Eis, et al. "An invasive cleavage assay for direct quantitation of specific RNAs", *Nat Biotechnol.*, 19(7):673-676, Abstract Only (2001).
Eisenstein. "Personalized, sequencing-based immune profiling spurs startups", Nat Biotechnol., 31(3):184-6 (2013). doi: 10.1038/nbt0313-184b.
Elhanati et al. "Quantifying selection in immune receptor repertoires", PNAS USA, 111(27): 9875-9880 (2014) doi: 10.1073/pnas.1409572111.
Elkord et al. "T regulatory cells in cancer: recent advances and therapeutic potential", *Expert Opinion on Biological Therapy*, 10(11): 1573-1586 (2010).
Emerson, et al. "Correlation of TCR diversity with immune reconstitution after cord blood transplant", Presented at the American Society of Clinical Oncology's annual meeting. May, 2012. Poster. 1 page.
Emerson et al. "Defining the Alloreactive T Cell Repertoire Using High-Throughput Sequencing of Mixed Lymphocyte Reaction Culture", *PLoS One*, 9(11): e111943 (2014).
Emerson, R.O. et al. "High-throughput sequencing of T-cell receptors reveals a homogeneous repertoire of tumour-infiltrating lymphocytes in ovarian cancer", *Journal of Pathology*, 231: 433-440 (2013).
Emerson, et al. "CD4+ and CD8+ T cell β antigen receptors have different and predictable V and J gene usage and CDR3 lengths", Presented at the Annual Meeting of The American Association of Immunologists 2012 in Boston, MA May, 2012. Poster.
Emerson, et al. "Estimating the ratio of CD4+ to CD8+ T cells using high-throughput sequence data", J Immunol Methods, 391(1-2):14-21 (2013). doi: 10.1016/j.jim.2013.02.002. Epub Feb. 18, 2013.
Emerson, et al. TCR repertoire diversity assessed with immunosequencing is associated with patient mortality following cord blood transplant. Presented for the 2014 ASH Annual Meeting. Poster. 1 page. Dec. 5-9, 2014.
Estorninho, et al. "A novel approach to tracking antigen-experienced CD4 T cells into functional compartments via tandem deep and shallow TCR clonotyping", J Immunol., 191(11): 5430-40 (2013). doi: 10.4049/jimmunol.1300622. Epub Oct. 25, 2013.
Erlich, et al. "Alta-Cyclic: a self-optimizing base caller for next-generation sequencing", *Nat Methods.*, 5(8): 679-682 (2008). doi: 10.1038/nmeth.1230. Epub Jul. 6, 2008.
European Application No. 09764927.1, Notice of Opposition dated Oct. 14, 2014, Reference# 547-7.
European Application No. 09764927.1, Notice of Opposition dated Oct. 14, 2014, Reference# BRO-0001EP.
European Application No. 09764927.1, European Opposition dated Oct. 15, 2014 (in French only).
Esendagli et al. "Malignant and non-malignant lung tissue areas are differentially populated by natural killer cells and regulatory T cells in non-small cell lung cancer", *Lung Cancer*, 59(1): 32-40 (2008).
European Application No. 10732172.1, Extended European Search Report dated May 29, 2012, 5 pages.
European Patent Application No. 12856834.2, Extended European Search Report dated Jul. 7, 2015, 8 pages.
European Patent Application No. 13195379.6, European Search Report and Opinion dated Mar. 13, 2014, 6 pages.
European Patent Application No. 11777704.5, European Search Report dated Jul. 26, 2013, 6 pages.
European Patent Application No. 12841014.9, Extended European Search Report dated May 4, 2015, 11 pages.
European Patent Application No. 12844825.5, Extended European Search Report dated Jun. 22, 2015, 6 pages.
European Patent Application No. 12859772.1, Extended European Search Report dated Sep. 2, 2015, 7 pages.
European Patent Application No. 12856015.8, Extended European Search Report dated Sep. 28, 2015, 7 pages.

(56) References Cited

OTHER PUBLICATIONS

European Patent Application No. 13804085.2, Extended European Search Report dated Nov. 16, 2015, 10 pages.
European Patent Application No. 13775514.6, Extended European Search Report dated Dec. 1, 2015, 12 pages.
European Patent Application No. 09764927.1, EPO's Communication of Notices of Opposition, dated Nov. 21, 2014.
European Patent Application No. 09764927.1, Patentee's Observations/Response dated May 27, 2015.
European Patent Application No. 09764927.1, Opponent's Response to Submission of the Patentee dated Nov. 23, 2015.
Ewing and Green, "Base-calling of automated sequencer traces using Phred. I. Accuracy Assessment," Genome Research, 8: 175-185 (1998).
Faham, M. et al. "Deep-sequencing approach for minimal residual disease detection in acute lymphoblastic leukemia", *Blood*, 120(26): 5173-5180 (2012).
Felsenstein, et al. "Evolutionary Trees from DNA Sequences: A Maximum Likelihood Approach", J Mol Evol, 17:368-376 (1981).
Ferradini et al. "Analysis of T Cell Receptor Variability in Tumor-infiltrating Lymphocytes from a Human Regressive Melanoma", *J. Clin. Invest.*, pp. 1183-190 (1993).
Ferrero, et al. "Multiple myeloma shows no intra-disease clustering of immunoglobulin heavy chain genes", *Haematologica*, 97(6): 849-853 (2012). doi: 10.3324/haematol.2011.052852. Epub Dec. 29, 2011.
Fisher et al. "The Relation Between the Number of Species and the Number of Individuals in a Random Sample of an Animal Population", *Journal of Animal Ecology*, 12(1): 42-58 (1943).
Flaherty et al. "Ultrasensitive detection of rare mutations using next-generation targeted resequencing", *Nucleic Acids Research*, 40(1): e2, 12 pages (2012).
Flicek and Birney, "Sense from sequence reads: methods for alignment and assembly," Nature Methods Supplement, 6(11s): S6-S12 (2009).
Frampton, et al. "Development and validation of a clinical cancer genomic profiling test based on massively parallel DNA sequencing", *Nat Biotechnol.*, 31(11): 1023-1031 (2013). doi: 10.1038/nbt.2696. Epub Oct. 20, 2013.
Frederiksson et al., "Multiplex amplification of all coding sequences within 10 cancer genes by Gene-Collector", Nucleic Acids Research, 35(7): e47 (2007).
Freeman, et al. "Quantitative RT-PCR: Pitfalls and Potential", *Biotechniques*, 6(1): 112-125 (1999).
Fridman, et al. "Prognostic and predictive impact of intra- and peritumoral immune infiltrates", *Cancer Research*, 71(17): 5601-5605 (2011). doi: 10.1158/0008-5472.CAN-11-1316. Epub Aug. 16, 2011.
Fritz et al. "Alterations in the spinal cord T cell repertoire during relapsing experimental autoimmune encephalomyelitis," *J Immunol*, 164:6662-6668 (2000).
Fuller, et al. "The challenges of sequencing by synthesis", *Nat Biotechnol.*, 7(11): 1013-23 (2009) (Abstract only). doi: 10.1038/nbt.1585. Epub Nov. 6, 2009.
Furmanski, et al. "Public T cell receptor β-chains are not advantaged during positive selection", *The Journal of Immunology*, 180(2): 1029-39 (2008).
Gauss, et al. "Mechanistic constraints on diversity in human V(D)J recombination", *Mol Cell Biol.*, 16(1):258-269 (1996).
Gawad, et al. "Massive evolution of the immunoglobulin heavy chain locus in children with B precursor acute lymphoblastic leukemia", *Blood*, 120(22):4407-4417 (2012). doi: 10.1182/blood-2012-05-429811. Epub Aug. 28, 2012.
Gerlinger and Swanton. "How Darwinian models inform therapeutic failure initiated by clonal heterogeneity in cancer medicine", *British Journal of Cancer*, 103(8):1139-1143 (2010). doi: 10.1038/sj.bjc.6605912. Epub Sep. 28, 2010.
Gerlinger, M. et al. "Ultra deep T cell receptor sequencing reveals the complexity and intratumour heterogeneity of T cell clones in renal cell carcinomas", *Journal of Pathology*, 231:424-432 (2013).

Germano, et al. "Clonality profile in relapsed precursor-B-ALL children by GeneScan and sequencing analyses. Consequences on minimal residual disease monitoring", *Leukemia*, 17(8):1573-1582 (2003).
Giannoni, et al. Allelic exclusion and peripheral reconstitution by TCR transgenic T cells arising from transduced human hematopoietic stem/progenitor cells, Mol Ther., 21(5):1044-54 (2013). doi: 10.1038/mt.2013.8. Epub Feb. 5, 2013.
Giga—Roche 454 FLX technology how it works. Fiche technique du Centre Interdisciplinaire de Genoproteomique Appliquee (Universite de Liege, Belgique). Accessed Oct. 15, 2014.
Gilbert, et al. "The isolation of nucleic acids from fixed, paraffin-embedded tissues-which methods are useful when?", *PLoS One*, 2(6):e537, 12 pages (2007).
Giuggio, et al. "Evolution of the intrahepatic T cell repertoire during chronic hepatitis C virus infection", *Viral Immunology*, 18(1):179-189 (2005).
Godelaine, et al. "Polyclonal CTL responses observed in melanoma patients vaccinated with dendritic cells pulsed with a MAGE-3.A1 peptide", *J Immunol.*, 171(9):4893-4897 (2003).
Golembowski, et al. "Clonal evolution in a primary cutaneous follicle center B cell lymphoma revealed by single cell analysis in sequential biopsies", *Immunobiology*, 201(5):631-644 (2000).
Gomes, et al. "Single-tube nested PCR using immobilized internal primers for the identification of dengue virus serotypes", *J Virol Methods.*, 145(1):76-9 (2007). Epub Jun. 15, 2007.
Gonzalez, S.F., et al. "Trafficking of B Cell Antigen in Lymph Nodes", *Ann. Rev. Immunol.*, 29: 215-233 (2011).
Gopalakrishnan, et al. "Unifying model for molecular determinants of the preselection Vβ repertoire", Proc Natl Acad Sci USA, 110(34):E3206-15 (2013). doi: 10.1073/pnas.1304048110. Epub Aug. 5, 2013.
Gorski, et al. "Circulating T cell repertoire complexity in normal individuals and bone marrow recipients analyzed by CDR3 size spectratyping. Correlation with immune status", *J Immunol.*, 152(10):5109-5119 (1994).
Gottenberg, et al. "Markers of B-lymphocyte activation are elevated in patients with early rheumatoid arthritis and correlated with disease activity in the ESPOIR cohort", *Arthritis Res Ther.*, 11(4): R114 (2009). doi: 10.1186/ar2773. Epub Jul. 23, 2009.
Gratama and Kern. "Flow cytometric enumeration of antigen-specific T lymphocytes", *Cytometry A*, 58(1): 79-86 (2004).
Gratama, et al. "Measuring antigen-specific immune responses", 2008 update. *Cytometry A.*, 73(11): 971-974 (2008). doi: 10.1002/cyto.a.20655.
Green, et al. "Clonal diversity of Ig and T-cell-receptor gene rearrangements identifies a subset of childhood B-precursor acute lymphoblastic leukemia with increased risk of relapse", *Blood*, 92(3):952-958 (1998).
Greenberg, et al. "Profile of immunoglobulin heavy chain variable gene repertoires and highly selective detection of malignant clonotypes in acute lymphoblastic leukemia" J Leukoc Biol., 57(6):856-864 (1995).
Greenman, et al. "Patterns of somatic mutation in human cancer genomes", *Nature*, 446(7132): 153-158 (2007).
Gribben, JG. "Stem cell transplantation in chronic lymphocytic leukemia", *Biol. Blood Marrow Transplant.*, 15(1 Suppl): 53-58 (2009). doi: 10.1016/j.bbmt.2008.10.022.
Grupp, et al. "Chimeric antigen receptor-modified T cells for acute lymphoid leukemia", N Engl J Med., 368(16):1509-18 (2013). doi: 10.1056/NEJMoa1215134. Epub Mar. 25, 2013.
Grupp, et al. "Adoptive transfer of autologous T cells improves T-cell repertoire diversity and long-term B-cell function in pediatric patients with neuroblastoma", Clin Cancer Res., 18(24):6732-41 (2012). doi: 10.1158/1078-0432.CCR-12-1432. Epub Oct. 23, 2012.
Gulliksen, et al. "Real-time nucleic acid sequence-based amplification in nanoliter volumes", *Anal Chem.*, 76(1): 9-14, Abstract Only (2004).
Gunderson et al. "Decoding Randomly Ordered DNA Arrays", *Genome Research*, 14: 870-877 (2004).

(56) References Cited

OTHER PUBLICATIONS

Guo, et al. "Sequence changes at the V-D junction of the $V_H1$ heavy chain of anti-phosphocholine antibodies alter binding to and protection against *Streptococcus pneumoniae*", *Int Immunol.*, 9(5):665-677 (1997).

Gupta, Pushpendra K. "Single-molecule DNA sequencing technologies for future genomics research", *Trends Biotechnol.*, 26(11): 602-611 (2008). doi: 10.1016/j.tibtech.2008.07.003. Epub Aug. 21, 2008.

Gurrieri, et al. "Chronic lymphocytic leukemia B cells can undergo somatic hypermutation and intraclonal immunoglobulin $V_HDJ_H$ gene diversification", J Exp Med., 196(5):629-639 (2002).

Hadrup, et al. "Parallel detection of antigen-specific T-cell responses by multidimensional encoding of MHC multimers", *Nat Methods*, 6(7): 520-526 (2009) (Abstract Only). doi: 10.1038/nmeth.1345. Epub Jun. 21, 2009.

Halldórsdóttir, et al. "Application of BIOMED-2 clonality assays to formalin-fixed paraffin embedded follicular lymphoma specimens: superior performance of the IGK assays compared to IGH for suboptimal specimens", *Leukemia & Lymphoma*, 48(7): 1338-1343 (2007).

Hanahan, et al. "Hallmarks of cancer: the next generation", *Cell*, 144(5): 646-674 (2011). doi: 10.1016/j.cell.2011.02.013.

Harismendy et al. "Evaluation of next generation sequencing platforms for population targeted sequencing studies", *Genome Biology*, 10:R32, 13 pages (2009).

Hathcock, et al. "ATM influences the efficiency of TCRβ rearrangement, subsequent TCRβ-dependent T cell development, and generation of the pre-selection TCRβ CDR3 repertoire", *PLoS One*, 8(4):e62188 (2013). doi: 10.1371/journal.pone.0062188. Print 2013.

Hawkins, et al. "Whole genome amplification—applications and advances", *Curr Opin Biotechnol.*, 13(1): 65-67 (2002).

He, et al. "IgH gene rearrangements as plasma biomarkers in Non-Hodgkin's lymphoma patients", *Oncotarget*, 2(3): 178-185 (2011).

Heger, M. "Studies Highlight Challenges of Immune Repertoire Sequencing's Clinical Applicability", available at http://www.genomeweb.com/sequencing/studies-highlight-challenges-immune-repertoire-sequencings-clinical-applicabilit?hq_e=el&hq_m=966798&hq_I=10&hq_v=2357e2f0b3. Accessed Apr. 6, 2011.

Heger. "Roche's 454 Eyes Immune Repertoire Sequencing as Key Application for Long- Read Platform". Feb. 2, 2010. 4 pages. http://www.genomeweb.com/print/932624.

Hill, et al. "Using ecological diversity measures with bacterial communities", *FEMS Microbiol Ecol.*, 43(1):1-11 (2003). doi: 10.1111/j.1574-6941.2003.tb01040.x.

Hirohata, et al. "Regulation of human B cell function by sulfasalazine and its metabolites", *Int Immunopharmacol.*, 2(5): 631-640, Abstract Only (2002).

Hodges, E. et al. "Diagnostic role of tests for T cell receptor (TCR) genes", *J Clin Pathol.*, 56(1): 1-11 (2003).

Holder and Lewis. "Phylogeny estimation: traditional and bayesian approaches", Nat Rev Genet., 4(4): 275-84 (2009).

Holt. "Q &A: BC Cancer agency's Robert Holt on sequencing the immune repertoire in immune reconstitution," Genome Web (www.genomeweb.com) Jun. 30, 2009.

Holt and Jones. "The new paradigm of flow cell sequencing", *Genome Research*, 18:839-846 (2008).

Hoogenboom, et al. "Multi-subunit proteins on the surface of filamentous phage: methodologies for displaying antibody (Fab) heavy and light chains", *Nucleic Acids Res.*, 19(15): 4133-4137 (1991).

Hoogendoorn, et al. "Primary allogeneic T-cell responses against mantle cell lymphoma antigen-presenting cells for adoptive immunotherapy after stem cell transplantation", *Clin Cancer Res.*, 11(14): 5310-5318 (2005).

Hoos, et al. "Improved endpoints for cancer immunotherapy trials", *J Natl Cancer Inst.*, 102(18): 1388-1397 (2010). doi: 10.1093/jnci/djq310. Epub Sep. 8, 2010.

Hoover and Lubkowski. "DNAWorks: an automated method for designing oligonucleotides for PCR-based gene synthesis", *Nucleic Acids Res.*, 30(10): e43, 7 pages (2002).

Hosono, et al. "Unbiased whole-genome amplification directly from clinical samples", *Genome Res.*, 13(5): 954-964 (2003). Epub Apr. 14, 2003.

Hoven, et al. "Detection and isolation of antigen-specific B cells by the fluorescence activated cell sorter (FACS)", *J Immunol Methods*, 117(2): 275-284, Abstract Only, 2 pages (1989).

Howe, et al. "T cell receptor clonotype analysis of T cell responses: Diagnostic application of a clonotypic database", *Blood*, 102:Abstract 3918 (2003).

Huang, et al. "Isolation of cell-free DNA from maternal plasma using manual and automated systems", *Methods Mol Biol.*, 444: 203-208, Abstract Only (2008). doi: 10.1007/978-1-59745-066-9_15.

Huh, et al. "Microfluidics for flow cytometric analysis of cells and particles", *Physiol Meas.*, 26(3): R73-98, Abstract Only (2005). Epub Feb. 1, 2005.

Huijsmans, et al. "Comparative analysis of four methods to extract DNA from paraffin-embedded tissues: effect on downstream molecular applications", *BMC Res Notes*, 3:239, 9 pages (2010). doi: 10.1186/1756-0500-3-239.

Huse, et al. "Generation of a large combinatorial library of the immunoglobulin repertoire in phage lambda", *Science*, 246(4935): 1275-1281, Abstract Only (1989).

Hwang, H.Y. et al. "Identification of a Commonly used CDR3 Region of Infiltrating T Cells Expressing Vβ13 and Vβ15 Derived from Psoriasis Patients", *The Journal of Investigative Dermatology*, 120(3):359-364 (2003).

Iancu, et al. "Profile of a serial killer: cellular and molecular approaches to study individual cytotoxic T-cells following therapeutic vaccination", *J Biomed Biotechnol.*, 2011: 452606 (2011). doi: 10.1155/2011/452606. Epub Nov. 14, 2010.

Iijima et al. "A local macrophage chemokine network sustains protective tissue-resident memory CD4 T cells", Science, 346(6205): 93-8 (2014). doi: 10.1126/science.1257530. Epub Aug. 28, 2014.

Illumina. Genome analyzer pipeline software version 1.0 user guide. Part #1004759, 176 pages (2008).

Illumina. Data Sheet: Sequencing. Genomic Sequencing. Pub. No. 770.2008-016 Reference states: "Current as of Jan. 30, 2009", 6 pages (2010).

Illumina. Data Sheet, "TruSeq™ exome enrichment kit", 5 pages (2011).

Illumina Systems & Software, Technology Spotlight, DNA Sequencing with Solexa® Technology, Illumina, Inc., Pub. No. 770-2007-002, 4 pages (2007).

Illumina. TruSeq Sample Preparation Kit and Data Sheet. Illumina, Inc., San Diego, CA, 4 pages (2011).

Ishii et al. "Isolation and expression profiling of genes upregulated in the peripheral blood cells of systemic lupus erythematosus patients," *DNA Research*, 12:429-439 (2005).

Jacobi et al. "Activated memory B cell subsets correlate with disease activity in systemic lupus erythematosus: delineation by expression of CD27, IgD, and CD95", *Arthritis & Rheumatism*, 58(6):1762-1773 (2008).

Jacobi et al. "Correlation between circulating $CD27^{high}$ plasma cells and disease activity in patients with systemic lupus erythematosus" *Arthritis & Rheumatism*, 48(5):1332-1342 (2003).

Jaffe, et al. "Classification of lymphoid neoplasms: the microscope as a tool for disease discovery", *Blood*, 112(12): 4384-4399 (2008). doi: 10.1182/blood-2008-07-077982.

Jalla, et al. "Enumeration of lymphocyte subsets using flow cytometry: Effect of storage before and after staining in a developing country setting", *Indian J Clin Biochem.*, 19(2): 95-99 (2004). doi: 10.1007/B F02894264.

Jena, et al. "Amplification of genes, single transcripts and cDNA libraries from one cell and direct sequence analysis of amplified products derived from one molecule", *J. Immunol. Methods*, 190:199-213 (1996).

(56) References Cited

OTHER PUBLICATIONS

Jochems and Schlom. "Tumor-infiltrating immune cells and prognosis: the potential link between conventional cancer therapy and immunity", *Exp Biol Med* (Maywood), 236(5): 567-579 (2011). doi: 10.1258/ebm.2011.011007. Epub Apr. 12, 2011.

Johnson et al. "Polysaccharide A from the capsule of Bacteroides fragilis induces clonal CD4+ T cell expansion", J Biol Chem., 290(8): 5007-14 (2015). doi: 10.1074/jbc.M114.621771. Epub Dec. 24, 2014.

Jones, et al. "Human autoimmunity after lymphocyte depletion is caused by homeostatic T -cell proliferation", Proc Natl Acad Sci USA, 110(50) :20200-5 (2013). doi: 10.1073/pnas.1313654110. Epub Nov. 26, 2013.

Jung, et al. "Unraveling V(D)J recombination; insights into gene regulation", *Cell*, 116(2): 299-311 (2004).

Jurkat, Clone 6-1 (ATCC TIB-152) Webpage retrievable from the ATCC under http: /www.lgcstandards-atcc.org/Products/ All MB-152. aspx#characteristics. Accessed Oct. 14, 2014.

Kalinina, O. et al. "Nanoliter scale PCR with TaqMan detection", *Nucleic Acids Research*, 25(10):1999-2004 (1997).

Kanda, et al. "Immune recovery in adult patients after myeloablative dual umbilical cord blood, matched sibling, and matched unrelated donor hematopoietic cell transplantation", Biol Blood Marrow Transplant, 18(11):1664-1676 (2012). doi: 10.1016/j.bbmt. 2012.06.005. Epub Jun. 12, 2012.

Katz, S.C. et al. "T Cell Infiltrate Predicts Long-Term Survival Following Resection of Colorectal Cancer Liver Metastases," Ann. Surg. Oncol., 16:2524-2530 (2009).

Kedzierska, et al. "Tracking phenotypically and functionally distinct T cell subsets via T cell repertoire diversity", *Mol Immunol.*, 45(3): 607-618 (2008). Epub Aug. 24, 2007.

Kehrl, J.H. et al. "Chemoattractant Receptor Signaling and Its Role in Lymphocyte Motility and Trafficking", *Current Topics in Microbiology and Immunology*, 334:107-127 (2009).

Kim, et al. "An efficient and reliable DNA extraction method for preimplantation genetic diagnosis: a comparison of allele drop out and amplification rates using different single cell lysis methods", *Fertility and Sterility*, 92: 814-818 (2009).

Kircher, et al. "Improved base calling for the Illumina Genome Analyzer using machine learning strategies", *Genome Biol.*, 10(8): R83, 9 pages (2009). doi: 10.1186/gb-2009-10-8-r83. Epub Aug. 14, 2009.

Kirsch, et al. "Defining immunoglobulin somatic hypermutation in de novo diffuse large b-cell lymphoma patients: potential application prognosis and risk stratification", Presented for the 2014 ASH Annual Meeting. Poster. 1 page. Dec. 5-9, 2014.

Kirsch, et al. "High-throughput TCR sequencing provides added value in the diagnosis of cutaneous T-cell lymphoma", Presented for the 2014 ASH Annual meeting. Poster. 1 page. Dec. 5-9, 2014.

Kita, et al. "T cell receptor clonotypes in skin lesions from patients with systemic lupus erythematosus", *Journal of Investigative Dermatology*,110(1): 41-6 (1988).

Klarenbeek, P.L. et al. "Human T-cell memory consists mainly of unexpanded clones", *Immunology Letters*, 133: 42-48 (2010).

Klebanoff, et al. "Therapeutic cancer vaccines: are we there yet?", *Immunol Rev.*, 239(1): 27-44 (2011). doi: 10.1111/j.1600-065X. 2010.00979.x.

Klenerman, et al. "Tracking T cells with tetramers: new tales from new tools", *Nat Rev Immunol.*, 2(4):263-272 (2002).

Kneba, et al. "Characterization of clone-specific rearrangement T-cell receptor gamma-chain genes in lymphomas and leukemias by the polymerase chain reaction and DNA sequencing", *Blood*, 84(2):574-581 (1994).

Kobari, et al. "T cells accumulating in the inflamed joints of a spontaneous murine model of rheumatoid arthritis become restricted to common clonotypes during disease progression", *Int Immunol.*, 16(1):131-138 (2004).

Koboldt et al., "VarScan: variant detection in massively parallel sequencing of individual and pooled samples", Bioinformatics, 25(17): 2283-2285 (2009).

Koch, et al. "Tumor infiltrating T lymphocytes in colorectal cancer: Tumor-selective activation and cytotoxic activity in situ," *Ann Surg.*, 244(6): 986-992; discussion 992-993 (2006).

Kojima et al. "PCR amplification from single DNA molecules on magnetic beads in emulsion: application for high-throughput screening of transcription factor targets", *Nucleic Acids Research*, 33: 17, e150, 9 pages (2005).

Kohlmann, et al. "Integration of next-generation sequencing into clinical practice: are we there yet?", *Semin Oncol.*, 39(1): 26-36, Abstract Only (2012). doi: 10.1053/j.seminoncol.2011.11.008.

Kou, et al. "T-Cell receptor Vbeta repertoire CDR3 length diversity differs within CD45RA and CD45RO T-cell subsets in healthy and human immunodeficiency virus-infected children", *Clin Diagn Lab Immunol.*, 7(6):953-9 (2000).

Krause et al. "Epitope-Specific Human Influenza Antibody Repertoires Diversify by B Cell Intraclonal Sequence Divergence and Interclonal Convergence", *The Journal of Immunology*, 187: 3704-3711 (2011).

Krueger, et al. "Large scale loss of data in low-diversity illumina sequencing libraries can be recovered by deferred cluster calling", *PLoS One*, 6(1): e16607, 7 pages (2011). doi: 10.1371/journal.pone. 0016607.

Ku, et al. "Exome sequencing: dual role as a discovery and diagnostic tool", *Ann Neurol.*, 71(1):5-14, Abstract Only (2012). doi: 10.1002/ana.22647.

Kumar, et al. "PEG-labeled nucleotides and nanopore detection for single molecule DNA sequencing by synthesis", *Sci Rep.*, 2:684, 8 pages (2012). Epub Sep. 21, 2012.

Kwak, et al. "Induction of immune responses in patients with B-cell lymphoma against the surface-immunoglobulin idiotype expressed by their tumors", *N Engl J Med.*, 327(17):1209-1215 (1992).

Kyu et al. "Frequencies of human influenza-specific antibody secreting cells or plasmablasts post vaccination from fresh and frozen peripheral blood mononuclear cells", *Journal of Immunological Methods*, 340: 42-47 (2009).

Ladányi, A., et al. "Prognostic impact of B-cell density in cutaneous melanoma", *Cancer Immunol. Immunother*, 60(12): 1729-1738 (2011).

Ladetto, et al., "Next-generation sequencing and real-time quantitative PCR for minimal residual disease (MRD) detection using the immunoglobulin heavy chain variable region: a methodical comparison in acute lymphoblastic leukemia (ALL), mantle cell lymphoma (MCL) and multiple myeloma (MM)", *Blood*, vol. 120 , No. 21, Abstract 788 (Conference Abstract), Entire Abstract (2012).

Ladetto, M. et al. "Real-time polymerase chain reaction in multiple myeloma: Quantitative analysis of tumor contamination of stem cell harvests", *Experimental Hematology*, 30:529-536 (2002).

Ladetto, M. et al. "Real-Time Polymerase Chain Reaction of Immunoglobulin Rearrangements for Quantitative Evaluation of Minimal Residual Disease in Multiple Myeloma", *American Society for Blood and Marrow Transplantation*, 6(3):241-253 (2000).

Landwehr-Kenzel, et al. "Novel GMP-compatible protocol employing an allogeneic B cell bank for clonal expansion of allospecific natural regulatory T cells", Am J Transplant., 14(3):594-606 (2014). doi: 10.1111/ajt.12629. Epub Jan. 27, 2014.

Langerak, et al. "Immunoglobulin/T-cell receptor clonality diagnostics", *Expert Opin. Med. Diagn.*, 1(3):451-461 (2007).

Langerak, et al. "Polymerase chain reaction-based clonality testing in tissue samples with reactive lymphoproliferations: usefulness and pitfalls. A report of the BIOMED-2 Concerted Action BMH4-CT98-3936", *Leukemia*, 21(2):222-229 (2007).

Laplaud et al. "Blood T-cell receptor β chain transcriptome in multiple sclerosis. Characterization of the T cells with altered CDR3 length distribution", *Brain*, 127:981-995 (2004).

Laplaud et al. "Serial blood T cell repertoire alterations in multiple sclerosis patients; correlation with clinical and MRI parameters", *Journal of Neuroimmunology*, 177(1-2):151-160 (2006).

Lassmann, et al. "Application of BIOMED-2 primers in fixed and decalcified bone marrow biopsies: analysis of immunoglobulin H receptor rearrangements in B-cell non-Hodgkin's lymphomas", *J Mol Diagn.*, 7(5): 582-591 (2005).

Lazareva-Ulitsky et al, "On the quality of tree-based protein classification," Bioinformatics, 21(9): 1876-1890 (2005).

(56) References Cited

OTHER PUBLICATIONS

Lee, et al. "Characterization of circulating T cells specific for tumor-associated antigens in melanoma patients", Nat Med., 5(6): 677-685, Abstract Only (1999).
Lee, et al. "Prognostic implications of type and density of tumour-infiltrating lymphocytes in gastric cancer", Br J Cancer, 99(10): 1704-1711 (2008). doi: 10.1038/sj.bjc.6604738. Epub Oct. 21, 2008.
Lefranc. "IMGT, the international ImMunoGeneTics database", Nucleic Acids Res., 31(1):307-310 (2003).
Leiden, J.M. et al. "The Complete Primary Structure of the T -Cell Receptor Genes From an Alloreactive Cytotoxic Human T-Lymphocyte Clone", Immunogenetics, 24(1): 17-23 (1986).
Leisner, et al. "One-pot, mix-and-read peptide-MHC tetramers", PLoS One, 3(2):e1678, 11 pages (2008). doi: 10.1371/journal.pone.0001678.
Leary, et al. "Development of personalized tumor biomarkers using massively parallel sequencing", Sci Transl Med., 2(20): 20ra14 (2010). doi: 10.1126/scitranslmed.3000702.
Leone, et al. "Molecular beacon probes combined with amplification by NASBA enable homogeneous, real-time detection of RNA", Nucleic Acids Research, 26(9): 2150-2155 (1998).
Lepore, et al. "Parallel T -cell cloning and deep sequencing of human MAIT cells reveal stable oligoclonal TCRβ repertoire", Nat Commun., 5:3866 (and Corrigendum) (2014). doi: 10.1038/ncomms4866.
Leproust, et al. "Synthesis of high-quality libraries of long (150mer) oligonucleotides by a novel depurination controlled process", Nucleic Acids Res., 38(8): 2522-2540 (2010). doi: 10.1093/nar/gkq163. Epub Mar. 22, 2010.
Lessin, et al. "Molecular diagnosis of cutaneous T-cell lymphoma: polymerase chain reaction amplification of T-cell antigen receptor beta-chain gene rearrangements", J Invest Dermatol., 96(3): 299-302 (1991).
Leventhal et al. "Immune reconstitution/immunocompetence in recipients of kidney plus hematopoietic stem/facilitating cell transplants", Transplantation, 99(2): 288-98 (2015). doi: 10.1097/TP.0000000000000605.
Li, et al. "Utilization of Ig heavy chain variable, diversity, and joining gene segments in children with B-lineage acute lymphoblastic leukemia: implications for the mechanisms of VDJ recombination and for pathogenesis", Blood, 103(12):4602-4609 (2004).
Li, et al. "An improved one-tube RT-PCR protocol for analyzing single-cell gene expression in individual mammalian cells", Anal. Bioanal. Chem., 397: 1853-1859 (2010).
Li, et al. "β cell-specific CD4+ T cell clonotypes in peripheral blood and the pancreatic islets are distinct", J Immunol. , 183(11): 7585-7591 (2009). doi: 10.4049/jimmunol.0901587. Epub Nov. 16, 2009.
Li, et al. "Clonal rearrangements in childhood and adult precursor B acute lymphoblastic leukemia: a comparative polymerase chain reaction study using multiple sets of primers", Eur J Haematol., 63(4):211-218 (1999).
Li, et al. "Detailed clonality analysis of relapsing precursor B acute lymphoblastic leukemia: implications for minimal residual disease detection", Leukemia Research, 25:1033-1045 (2001).
Li et al, "Mapping short DNA sequencing reads and calling variants using mapping quality scores," Genome Research, 18: 1851-1858 (2008).
Liedtke, et al. "A comparison of methods for RNA extraction from lymphocytes for RT-PCR", PCR Methods and Applications, 4(3): 185-187 (1994).
Lin, et al. "Multiplex genotype determination at a large number of gene loci", Proc Natl Acad Sci USA, 93(6): 2582-2587 (1996).
Liu, et al. "CD127 expression inversely correlates with FoxP3 and suppressive function of human CD4+ T reg cells", J Exp Med., 203(7): 1701-1711 (2006). Epub Jul. 3, 2006.
Lo, et al. "T cell immunodominance is dictated by the positively selecting self-peptide", Elife, 3:e01457 (2014). doi: 10.7554/eLife.01457. Epub Jan. 14, 2014.
Logan, et al., "High-throughput immunoglobulin gene sequencing quantifies minimal residual disease in CLL with 10e-6 sensitivity and strongly predicts relapse after allogeneic hematopoietic cell transplantation", Blood, vol. 118 (21), Abstract 2542 (2011).
Logan, A.C. et al. "High-throughput VDJ sequencing for quantification of minimal residual disease in chronic lymphocytic leukemia and immune reconstitution assessment", PNAS, 108(52): 21194-21199 (2011).
Logan, et al., "Massively parallel immunoglobulin gene sequencing provides ultra-sensitive minimal residual disease detection and predicts post-transplant relapse in acute lymphoblastic leukemia by three to six months", Blood, vol. 118 (21), Abstract 4104 (2011).
Lord et al. "T-cell receptor sequencing reveals the clonal diversity and overlap of colonic effector and FOXP3+ T cells in ulcerative colitis", Inflamm Bowel Dis., 21(1):19-30 (2015). doi: 10.1097/MIB.0000000000000242.
Lossius et al. "High-throughput sequencing of TCR repertoires in multiple sclerosis reveals intrathecal enrichment of EBV-reactive CD8+ T cells", Eur J Immunol., 44(11): 3439-52 (2014). doi: 10.1002/eji.201444662. Epub Sep. 16, 2014.
Lossos, et al. "Transformation of follicular lymphoma to diffuse large-cell lymphoma: alternative patterns with increased or decreased expression of c-myc and its regulated genes", PNAS, 99(13): 8886-8891 (2002). Epub Jun. 19, 2002.
Lovisa, et al. "IGH and IGK gene rearrangements as PCR targets for pediatric Burkitt's lymphoma and mature B-ALL MRD analysis", Lab Invest., 89(10):1182-1186 (2009).
Lowe, T., et al. "A computer program for selection of oligonucleotide primers for polymerase chain reactions," Nucleic Acids Research, 18(7):1757-1761 (1990).
Lowman, et al. "Monovalent phage display: a method for selecting variant proteins from random libraries", Methods: A Companion to Methods in Enzymology, 3: 205-216, Abstract Only (1991).
Lyamichev, et al. "Polymorphism identification and quantitative detection of genomic DNA by invasive cleavage of oligonucleotide probes", Nat Biotechnol., 17(3): 292-396 (1999).
Luo et al. "Analysis of the interindividual conservation of T cell receptor α- and β-chain variable regions gene in the peripheral blood of patients with systemic lupus erythematosus", Clinical & Experimental Immunology, 154(3):316-324 (2008).
Mackay, et al. "Real-time PCR in virology", Nucleic Acids Res., 30(6): 1292-305 (2002).
Mahmoud, S.M.A. et al. "Tumor-Infiltrating CD8+ Lymphocytes Predict Clinical Outcome in Breast Cancer", Journal of Clinical Oncology, 29(15): 1949-1955 (2011).
Maldonado, et al. "Intramuscular therapeutic vaccination targeting HPV16 induces T cell responses that localize in mucosal lesions", Sci Transl Med., 6(221): 221ra13 (2014). doi: 10.1126/scitranslmed.3007323.
Malyguine, et al. "ELISPOT Assay for Monitoring Cytotoxic T Lymphocytes (CTL) Activity in Cancer Vaccine Clinical Trials", Cells, 1(2): 111-126 (2012). doi: 10.3390/cells1020111.
Manion et al., "Reducing Error in Next Generation Sequencing Data with NextGENe Software's Condensation Tool™", Mar. 2009, pp. 1-3. XP055226038.
Manrao, et al. "Reading DNA at single-nucleotide resolution with a mutant MspA nanopore and phi29 DNA polymerase", Nat Biotechnol., 30(4): 349-353 (2012). doi: 10.1038/nbt.2171.
Mar et al. "Inferring steady state single-cell gene expression distributions from analysis of mesoscopic samples", Genome Biology, 7(12): R119, 12 pages (2006).
Mardis. "Next-generation DNA sequencing methods", Annu. Rev. Genomics Hum. Genet., 9:387-402 (2008). doi: 10.1146/annurev.genom.9.081307.164359.
Marelli-Berg, F.M., et al. "Memory T-cell trafficking: new directions for busy commuters", Immunology, 130:158-165 (2010).
Marrero, et al. "High-throughput sequencing of islet-infiltrating memory CD4+ T cells reveals a similar pattern ofTCR Vβ usage in prediabetic and diabetic NOD mice", PLoS One, 8(10):e76546 (2013). doi: 10.1371/journal.pone.0076546. eCollection 2013.

(56) References Cited

OTHER PUBLICATIONS

Martin-Jimenez, et al. "Molecular characterization of heavy chain immunoglobulin gene rearrangements in Waldenström's macroglobulinemia and IgM monoclonal gammopathy of undetermined significance", Haematologica, 92(5): 635-642 (2007).
Mary et al. "Analysis of gene expression at the single-cell level using microdroplet-based microfluidic technology", Biomicrofluidics, 5: 024109-1-024109-10 (2011).
Maryanski, J.L. et al., "A quantitative, single-cell PCR analysis of an antigen-specific TCR repertoire 8 selected during an in vivo CD8 response: direct evidence for a wide range of clone sizes with uniform tissue distribution", Molecular Immunology, 36:745-753 (1999).
Mato et al. "Correlation of clonal T cell expansion with disease activity in systemic lupus erythematosus", Int Immunol., 9(4):547-554 (1997).
Matolcsy, et al. "Clonal evolution of B cells in transformation from low- to high-grade lymphoma", Eur. J. Immunol., 29(4):1253-1264 (1999).
Matsubara, et al. "Microchamber array based DNA quantification and specific sequence detection from a single copy via PCR in nanoliter volumes", Biosens Bioelectron, 20(8): 1482-1490, Abstract Only (2005).
Matsumoto et al. "CDR3 spectratyping analysis of the TCR repertoire in Myasthenia Gravis", The Journal of Immunology, 176:5100-5107 (2006).
Matsumoto et al. "Complementarity-determining region 3 spectratyping analysis of the TCR repertoire in multiple sclerosis", The Journal of Immunology, 170:4846-4853 (2003).
Mattoo et al. "De novo oligoclonal expansions of circulating plasmablasts in active and relapsing IgG4-related disease", J Allergy Clin Immunol., 134(3):679-87 (2014). doi: 10.1016/j.jaci.2014.03.034. Epub May 6, 2014.
Mazor et al. "Antibody internalization studied using a novel IgG binding toxin fusion", Journal of Immunological Methods, 321: 41-59 (2007).
Mazumder, et al., "Detection of multiple myeloma cells in peripheral blood using high-throughput sequencing assay" Blood, vol. 120, No. 21, Abstract 321 (Conference Abstract), Entire Abstract (2012).
McGoldrick, et al. "Cytomegalovirus-specific T cells are primed early after cord blood transplant but fail to control virus in vivo", Blood, 121(14): 2796-803 (2013). doi: 10.1182/blood-2012-09-453720. Epub Feb. 14, 2013.
Mei et al. "Blood-borne human plasma cells in steady state are derived from mucosal immune responses", Blood, 113(11): 2461-2469 (2009).
Meijer et al. "Isolation of Human Antibody Repertoires with Preservation of the Natural Heavy and Light Chain Pairing", J. Mol. Biol., 358: 764-772 (2006).
Meier, et al. "Fractal organization of the human T cell repertoire in health and after stem cell transplantation", Biol Blood Marrow Transplant., 19(3):366-77 (2013). doi: 10.1016/j.bbmt.2012.12.004. Epub Jan. 11, 2013.
Meier et al. "Simultaneous evaluation of T-cell and B-cell clonality, t(11;14) and t(14;18), in a single reaction by a four-color multiplex polymerase chain reaction assay and automated High-Resolution fragment analysis", American Journal of Pathology, 159(6): 2031-2043 (2001).
Meier, et al. "The influence of different stimulation conditions on the assessment of antigen-induced CD154 expression on CD4+ T cells", Cytometry A., (11):1035-1042 (2008). doi: 10.1002/cyto.a.20640.
Meleshko, et al. "Rearrangements of IgH, TCRD and TCRG genes as clonality marker of childhood acute lymphoblastic leukemia", Experimental Oncology, 27(4):319-324 (2005).
Menezes et al. "A public T cell clonotype within a heterogeneous autoreactive repertoire is dominant in driving EAE", J Clin Invest, 117(8):2176-2185 (2007).

Merriam-Webster, 2 pages, (definition of "e.g.," accessed Apr. 25, 2014).
Merriam-Webster, 4 pages (definition of "substantial," accessed Apr. 25, 2014).
Metzker, "Sequencing Technologies—The Next Generation", Nature Reviews, Genetics, 11:31-46 (2010).
Miceli and Parnes. "The roles of CD4 and CD8 in T cell activation", Seminars in Immunology, 3(3): 133-141 (1991). Abstract only.
Michalek, et al. "Detection and long-term in vivo monitoring of individual tumor-specific T cell clones in patients with metastatic melanoma", J Immunol., 178(11):6789-6795 (2007).
Michalek, et al. "Identification and monitoring of graft-versus-host specific T-cell clone in stem cell transplantation", The Lancet, 361(9364): 1183-1185 (2003).
Miller, et al., "Assembly algorithms for next-generation sequencing data", Genomics, 95(6): 315-327 (2010).
Miltenyi, et al. "High gradient magnetic cell separation with MACS", Cytometry, 11(2): 231-238 (1990).
Mitra, et al. "Fluorescent in situ sequencing on polymerase colonies", Anal Biochem., 320(1): 55-65, Abstract Only (2003).
Mittelstadl, et al. "Thymocyte responsiveness to endogenous glucocorticoids is required for immunological fitness", J Clin Invest., 122(7):2384-94 (2012). doi: 10.1172/JCI63067. Epub Jun. 1, 2012.
Miyashita, et al. "N-Methyl substituted 2',4'- BNANC: a highly nuclease-resistant nucleic acid analogue with high-affinity RNA selective hybridization", Chem Commun (CAMB), (36): 3765-3767, Abstract Only (2007). Epub Jul. 9, 2007.
Moen, et al. "Immunoglobulin G and A antibody responses to Bacteroides forsyth and Prevotella intermedia in sera and synovial fluids of arthritis patients", Clin Diagn Lab Immunol., 10(6): 1043-1050 (2003).
Molloy, et al. "Soluble T cell receptors: novel immunotherapies", Curr Opin Pharmacol., 5(4): 438-443 (2005) (Abstract Only).
Moody, et al. "Antigen-specific B cell detection reagents: use and quality control", Cytometry A., 73(11): 10861092 (2008). doi: 10.1002/cyto.a.20599.
Morgan, et al. "Cancer regression in patients after transfer of genetically engineered lymphocytes", Science, 314(5796): 126-129 (2006). Epub Aug. 31, 2006.
Morozova et al. "Applications of New Sequencing Technologies for Transcriptome Analysis", Annu. Rev. Genomics Hum. Genet., 10: 135-151 (2009).
Morrissy et al. "Next-generation tag sequencing for cancer gene expression profiling", Genome Research, 19: 1825-1835 (2009).
Moss, et al. "The human T cell receptor in health and disease", Annu. Rev. Immunol., 10:71-96 (1992).
Moura, et al. "Alterations on peripheral blood B-cell subpopulations in very early arthritis patients", Rheumatology (Oxford), 49(6): 1082-1092 (2010). doi: 10.1093/rheumatology/keq029. Epub Mar. 7, 2010.
Mueller, et al. "Human Treg responses allow sustained recombinant adeno-associated virus-mediated transgene expression", J Clin Invest., 123(12): 5310-8 (2013). doi: 10.1172/JCI70314. Epub Nov. 15, 2013.
Muraro, et al. "T cell repertoire following autologous stem cell transplantation for multiple sclerosis", J Clin Invest., 124(3): 1168-72 (2014). doi: 10.1172/JCI71691. Epub Feb. 17, 2014.
Murugan, et al. "Statistical inference of the generation probability of T-cell receptors from sequence repertoires", PNAS, 109(40): 16161-16166 (2012). doi: 10.1073/pnas.1212755109. Epub Sep. 17, 2012.
Naito, et al. "CD8+ T cells infiltrated within cancer cell nests as a prognostic factor in human colorectal cancer", Cancer Research, 58(16): 3491-3494 (1998).
Nakano, et al. "Single-molecule PCR using water-in-oil emulsion", J Biotechnol., 102(2): 117-124, Abstract Only (2003).
Nardi, et al. "Quantitative monitoring by polymerase colony assay of known mutations resistant to ABL kinase inhibitors", Oncogene, 27(6):775-782 (2008). Epub Aug. 6, 2007, 1-8.
Navarrete, et al. "Upfront immunization with autologous recombinant idiotype Fab fragment without prior cytoreduction in indolent

(56) References Cited

OTHER PUBLICATIONS

B-cell lymphoma", *Blood*, 117(5): 1483-1491 (2011). doi: 10.1182/blood-2010-06-292342. Epub Nov. 2, 2010.

Neale, et al. "Comparative analysis of flow cytometry and polymerase chain reaction for the detection of minimal residual disease in childhood acute lymphoblastic leukemia", *Leukemia*, 18(5):934-938 (2004).

Needleman and Wunsch. "A general method applicable to the search for similarities in the amino acid sequence of two proteins", *J Mol Biol.*, 48(3): 443-453 (1970).

Neller, et al. "High frequency of herpesvirus-specific clonotypes in the human T cell repertoire can remain stable over decades with minimal turnover", J Virol., 87(1): 697-700 (2013). doi: 10.1128/NI.02180-12. Epub Oct. 17, 2012.

Nelson. "CD20+ B cells: the other tumor-infiltrating lymphocytes", *The Journal of Immunology*, 185(9): 49774982 (2010). doi: 10.4049/jimmunol.1001323.

Newman, et al. "Identification of an antigen-specific B cell population", *J Immunol Methods*, 272(1-2): 177-187, Abstract Only (2003).

Nie, et al. "Optical detection of single molecules", *Annu. Rev. Biophys. Biomol. Struct.*, 26: 567-596 (1997).

Nielsen, et al. "Peptide nucleic acid (PNA). A DNA mimic with a pseudopeptide backbone", *Chem. Soc. Rev.*, 26:73-78, Abstract Only (1997).

Nolan, T. et al. "Quantification of mRNA using real-time RT-PCR", *Nature Protocols*, 1(3):1559-1582 (2006).

Nosho, et al. "Tumour-infiltrating T-cell subsets, molecular changes in colorectal cancer, and prognosis: cohort study and literature review", *J Pathol.*, 222(4): 350-366 (2010). doi: 10.1002/path.2774.

Novak, et al. "Single Cell Multiplex Gene Detection and Sequencing Using Microfluidically-Generated Agarose Emulsions", *Angew Chem Int Ed Engl.*, 50(2): 390-395, with supplemental materials (2011).

Nucleis product webpage, "Exonuclease I-Shrimp alkaline phosphatase clean up of PCR products," (Published on webpage 2013) Downloaded Dec. 15, 2015.

Oble, et al. "Focus on TILs: prognostic significance of tumor infiltrating lymphocytes in human melanoma", *Cancer Immunity*, 9: 3, 20 pages (2009).

O'Brian et al., "Sorting out mix-ups. The provenance of tissue sections may be confirmed by PCR using microsatellite markers", Am. J. Clin. Pathol., 106(6): 758-764 (1996). (Abstract Only).

Oelke, et al. "Ex vivo induction and expansion of antigen-specific cytotoxic T cells by HLA-Ig-coated artificial antigen-presenting cells", *Nat Med.*, 9(5): 619-624 (2003). Epub Apr. 21, 2003.

Ohtani. "Focus on TILs: prognostic significance of tumor infiltrating lymphocytes in human colorectal cancer", *Cancer Immunity*, 7: 4, 9 pages (2007).

Okajima et al. "Analysis of T cell receptor Vβ diversity in peripheral CD4+ and CD8+ T lymphocytes in patients with autoimmune thyroid diseases", *Clinical & Experimental Immunology*, 155:166-172 (2008).

Okello et al. "Comparison of methods in the recovery of nucleic acids from archival formalin-fixed paraffin-embedded autopsy tissues", *Anal Biochem.*, 400(1): 110-117 (2010). doi: 10.1016/j.ab.2010.01.014. Epub Jan. 15, 2010.

Ottensmeier, et al. "Analysis of VH genes in follicular and diffuse lymphoma shows ongoing somatic mutation and multiple isotype transcripts in early disease with changes during disease progression", *Blood*, 91(11): 4292-4299 (1998).

Pagès, Franck. Tumor-associated immune parameters for personalized patient care. Sci Transl Med., 5(214):214fs42 (2013). doi: 10.1126/scitranslmed.3007942.

Palmowski, et al. "The use of HLA class I tetramers to design a vaccination strategy for melanoma patients", *Immunol Rev.*, 188: 155-163 (2002) (Abstract Only).

Palomaki, et al. "DNA sequencing of maternal plasma reliably identifies trisomy 18 and trisomy 13 as well as Down syndrome: an international collaborative study", *Genet Med.*, 14(3): 296-305 (2012). doi: 10.1038/gim.2011.73. Epub Feb. 2, 2012.

Pan, et al. "A new FACS approach isolates hESC derived endoderm using transcription factors", *PLoS One*, 6(3): e17536, 9 pages (2011). doi: 10.1371/journal.pone.0017536.

Panzer-Grümayer et al. "Immunogenotype changes prevail in relapses of young children with TEL-AML1-positive acute lymphoblastic leukemia and derive mainly from clonal selection", *Clin Cancer Research*, 11(21):7720-7727 (2005).

Parmigiani, et al. "Design and analysis issues in genome-wide somatic mutation studies of cancer", *Genomics*, 93(1): 17-21 (2009). doi: 10.1016/j.ygeno.2008.07.005. Epub Aug. 23, 2008.

Pasqual et al. "Quantitative and qualitative changes in V-J alpha rearrangements during mouse thymocytes differentiation: implication for a limited T cell receptor alpha chain repertoire", *Journal of Experimental Medicine*, 196(9): 1163-1173 (2002). XP002322207 ISSN: 0022-1007.

Paszkiewicz et al, "De novo assembly of short sequence reads," Briefings in Bioinformatics, 11(5): 457-472 (2010).

Payne, et al. "Peripheral blood mononuclear cells of patients with breast cancer can be reprogrammed to enhance anti-HER-2/neu reactivity and overcome myeloid-derived suppressor cells", Breast Cancer Res Treat., 142(1):45-57 (2013). doi: 10.1007/s10549-013-2733-5. Epub Oct. 25, 2013.

Peet. "The Measurement of Species Diversity", *Annual Review of Ecology and Systematics*, 5: 285-307, Abstract Only (1974).

Petrosino, et al. "Metagenomic pyrosequencing and microbial identification", *Clin Chem.*, 55(5): 856-866 (2009). doi: 10.1373/clinchem.2008.107565. Epub Mar. 5, 2009.

PCT/US2009/006053, International Search Report dated Jun. 15, 2010, 6 pages.

PCT/US2009/006053, Written Opinion dated Jun. 15, 2010, 4 pages.

PCT/US2009/006053, International Preliminary Report on Patentability dated May 10, 2011, 5 pages.

PCT/US2010/037477, International Search Report and Written Opinion dated Sep. 24, 2010, 10 pages.

PCT/US2010/037477, International Preliminary Report on Patentability dated Jan. 4, 2012, 7 pages.

PCT/US2011/000791, International Search Report and Written Opinion dated Sep. 22, 2011, 13 pages.

PCT/US2011/000791, International Preliminary Report on Patentability dated Nov. 6, 2012, 10 pages.

PCT/US2011/049012, International Search Report and Written Opinion dated Apr. 10, 2012, 9 pages.

PCT/US2011/049012, International Preliminary Report on Patentability dated Feb. 26, 2013, 5 pages.

PCT/US2012/058989, International Search Report and Written Opinion dated Mar. 29, 2013, 12 pages.

PCT/US2012/058989, International Preliminary Report on Patentability dated Apr. 15, 2014, 8 pages.

PCT/US2012/061977, International Preliminary Report on Patentability dated May 6, 2014, 7 pages.

PCT/US2012/068617, International Preliminary Report on Patentability dated Jun. 10, 2014, 6 pages.

PCT/US2012/070674, International Search Report and Written Opinion dated Feb. 22, 2013, 8 pages.

PCT/US2012/070674, International Preliminary Report on Patentability dated Aug. 5, 2014, 6 pages.

PCT/US2013/043420, International Search Report and Written Opinion dated Oct. 25, 2013, 8 pages.

PCT/US2013/043420, International Preliminary Report on Patentability dated May 19, 2015, 7 pages.

PCT/US2013/065493, International Search Report and Written Opinion dated Jan. 20, 2014, 14 pages.

PCT/US2013/065493, International Preliminary Report on Patentability dated Apr. 21, 2015, 10 pages.

PCT/US2013/065509, International Search Report and Written Opinion dated Jan. 20, 2014, 9 pages.

PCT/US2013/065509, International Preliminary Report on Patentability dated Apr. 21, 2015, 6 pages.

PCT/US2013/065757, International Search Report and Written Opinion dated Jan. 21, 2014, 10 pages.

(56) References Cited

OTHER PUBLICATIONS

PCT/US2013/065757, International Preliminary Report on Patentability dated Apr. 28, 2015, 6 pages.
PCT/US2013/037258, International Search Report and Written Opinion dated Aug. 19, 2013, 8 pages.
PCT/US2013/037258, International Preliminary Report on Patentability dated Oct. 21, 2014, 6 pages.
PCT/US2014/017416, International Search Report dated May 12, 2014, 9 pages.
PCT/US2014/017416, Written Opinion dated May 12, 2014, 9 pages.
PCT/US2014/017416, International Preliminary Report on Patentability dated Aug. 25, 2015, 10 pages.
PCT/US2014/030859, International Search Report and Written Opinion dated Jul. 18, 2014, 14 pages.
PCT/US2014/030859, International Preliminary Report on Patentability dated Sep. 15, 2015, 8 pages.
PCT/US2014/047909, International Search Report dated Nov. 17, 2014.
PCT/US2014/047909, Written Opinion dated Nov. 17, 2014, 9 pages.
PCT/US2015/010904, International Search Report dated May 6, 2015, 4 pages.
PCT/US2015/010904, Written Opinion dated May 6, 2015, 4 pages.
PCT/US2015/018967, International Search Report and Written Opinion dated Jul. 30, 2015, 17 pages.
PCT/US2015/019029, International Search Report and Written Opinion dated Sep. 15, 2015, 19 pages.
Pekin, D. et al. "Quantitative and sensitive detection of rare mutations using droplet-based microfluidics", Lab Chip, 11(3): 2156-2166 (2011).
Pels et al. "Clonal evolution as pathogenetic mechanism in relapse of primary CNS lymphoma", Neurology, 63(1):167-169 (2004).
Pira et al. "Human naive CD4 T-cell clones specific for HIV envelope persist for years in vivo in the absence of antigenic challenge", J Acquir Immune Defic Syndr., 40(2):132-139 (2005).
Polstra, et al. "Development of real-time NASBA assays with molecular beacon detection to quantify mRNA coding for HHV-8 lytic and latent genes", BMC Infect Dis., 2: 18 (2002). Epub Sep. 4, 2002.
Pop and Salzberg. "Bioinformatics challenges of new sequencing technology", NIH, Trends Genet., 24(3): 142-149 (2008).
Pourmand, et al. "Direct electrical detection of DNA synthesis",PNAS, 103(17): 6466-6470 (2006). Epub Apr. 13, 2006.
Porter, et al. "Chimeric antigen receptor-modified T cells in chronic lymphoid leukemia", N Engl J Med., 365(8):725-33 (2011). doi: 10.1056/NEJMoa1103849. Epub Aug. 10, 2011.
Poschke et al. "A phase I clinical trial combining dendritic cell vaccination with adoptive T cell transfer in patients with stage IV melanoma", Cancer Immunol Immunother., 63(10): 1061-71 (2014). doi: 10.1007/s00262-014-1575-2. Epub Jul. 4, 2014.
Prabakaran et al. "454 antibody sequencing—error characterization and correction", BMC Research Notes, 4: 404 (2011).
Puisieux, I. et al., "Oligoclonality of Tumor-Infiltrating Lymphocytes from Human Melanomas," The Journal of Immunology, 153:2807-2818 (1994).
Putnam, et al. "Clinical grade manufacturing of human alloantigen-reactive regulatory T cells for use in transplantation", Am J Transplant., 13(11): 3010-20 (2013). doi: 10.1111/ajt.12433. Epub Sep. 18, 2013.
Quick. SOLiD System—a next-gen DNA sequencing platform announced, Gizmag online magazine, http://www.mizmag.com/go/8248, pp. 1-5, Oct. 2007.
Ramesh, et al. "Clonal and constricted T cell repertoire in Common Variable Immune Deficiency", Clin Immunol., pii: S1521-6616(15)00004-2 (2015). doi: 10.1016/j.clim.2015.01.002. [Epub ahead of print].
Ramsden, et al. "V(D)J recombination: Born to be wild", Semin Cancer Biol., 20(4): 254-260 (2010). doi: 10.1016/j.semcancer. 2010.06.002. Epub Jul. 1, 2010.

Ray, et al. "Single cell multiplex PCR amplification of five dystrophin gene exons combined with gender determination", Molecular Human Reproduction, 7(5): 489-494 (2001).
Reddy, et al. "Monoclonal antibodies isolated without screening by analyzing the variable-gene repertoire of plasma cells", Nature Biotechnology, 28(9): 965-969 (2010). doi: 10.1038/nbt.1673. Epub Aug. 29, 2010.
Reddy and Georgiou. "Systems analysis of adaptive immunity by utilization of high-throughput technologies", Current Opinion in Biotechnology, 22(4): 584-589 (2011).
Ria, et al. "Collagen-specific T-cell repertoire in blood and synovial fluid varies with disease activity in early rheumatoid arthritis", Arthritis Res Ther., 10(6):R135, 18 pages (2008). Epub Nov. 17, 2008.
Rickinson and Moss. "Human cytotoxic T lymphocyte responses to Epstein-Barr virus infection", Annu Rev Immunol., 15:405-431 (1997).
Rieder, et al. "A normalization procedure for removal of residual multiplex PCR amplification bias from ultra-deep sequencing of the TCR repertoire", (Program #530W). Presented at the 62nd Annual Meeting of the American Society of Human Genetics, Nov. 7, 2012 in San Francisco, California. 2 pages.
Rieder, et al. "A normalization procedure for removal of residual multiplex PCR amplification bias from ultra-deep sequencing of the TCR repertoire", Presented at the Annual Meeting of the American Society of Hematology 2012 in Atlanta, Georgia Dec. 8-11, 2012. Poster. 1 page.
Risitano et al. "In-vivo dominant immune responses in aplastic anaemia: molecular tracking of putatively pathogenetic T-cell clones by TCRβ-CDR3 sequencing", Lancet, 364:355-364 (2004).
Robert, et al. "CTLA4 blockade broadens the peripheral T -cell receptor repertoire", Clin Cancer Res., 20(9):2424-32 (2014). doi: 10.1158/1078-0432.CCR-13/2648. Epub Feb. 28, 2014.
Robins, H. et al. "Ultra-sensitive detection of rare T cell clones", Journal of Immunological Methods, 375(1-2): 14-19 (2012).
Robins, et al. "CD4+ and CD8+ T cell β antigen receptors have different and predictable V and J gene usage and CDR3 lengths", J. Immunol., 188: 115.10, Abstract (2012).
Robins et al. "Detecting and monitoring lymphoma with high-throughput sequencing" Oncotarget, 2:287-288 (2011).
Robins, H. et al. "Digital Genomic Quantification of Tumor Infiltrating Lymphocytes", Science Translational Medicine, 5:214ra169, 19 pages, Supplementary Materials (2013).
Robins, et al. "Effects of aging on the human adaptive immune system revealed by high-throughput DNA sequencing of T cell receptors", J Immunol., 188: 47.16, Abstract (2012).
Robins, et al. "High-throughput sequencing of T -cell receptors." Sep. 2010. Poster. 1 page.
Robins, et al. "Immune profiling with high-throughput sequencing." Presented for the ASHI 2011 conference. Oct. 2011. Poster. 1 page.
Robins, et al. "Immunosequencing: applications of immune repertoire deep sequencing", Curr Opin Immunol., 25(5): 646-652 (2013). doi: 10.1016/j.coi.2013.09.017. Epub Oct. 16, 2013.
Robins, et al. "Overlap of the human CD8+ T cell receptor repertoire." Oct. 2010. Poster. 1 page.
Robins. "Overlap and effective size of the human CD8+ T cell repertoire", Keystone Symposia held Oct. 27, 2010 to Nov. 1, 2010. Immunological Mechanisms of Vaccination (Abstract). Available online Sep. 27, 2010, 1 page.
Robins, H. et al. "The Computational Detection of Functional Nucleotide Sequence Motifs in the Coding Regions of Organisms", Exp Biol Med, 233(6): 665-673 (2008).
Ronaghi, et al. "A sequencing method based on real-time pyrophosphate", Science, 281(5375): 363, 365, 5 pages (1998).
Rosenberg, S.A. et al. "New Approach to the Adoptive Immunotherapy of Cancer with Tumor-Infiltrating Lymphocytes", Science, 233(4770): 1318-1321 (1986).
Rosenquist, et al. "Clonal evolution as judged by immunoglobulin heavy chain gene rearrangements in relapsing precursor-B acute lymphoblastic leukemia", Eur J Haematol., 63(3):171-179 (1999).
Rothberg, et al. "An integrated semiconductor device enabling non-optical genome sequencing", Nature, 475(7356): 348-352 (2011). doi: 10.1038/nature10242.

(56) References Cited

OTHER PUBLICATIONS

Rothberg et al. "The development and impact of 454 sequencing", *Nature Biotechnology*, 26(10): 1117-1124 (2008).
Rougemont, et al. "Probabilistic base calling of Solexa sequencing data", *BMC Bioinformatics*, 9:431, 12 pages (2008).
Rozen, S. et al. "Primer3 on the WWW for General Users and for Biologist Programmers", *Methods in Molecular Biology, Bioinformatics Methods and Protocols*, 132:365-386 (2000).
Ryan et al. "Clonal evolution of lymphoblastoid cell lines", *Laboratory Investigation*, 86(11):1193-1200 (2006). Epub Oct. 2, 2006.
Sanchez-Freire et al. "Microfluidic single-cell real-time PCR for comparative analysis of gene expression patterns", *Nature Protocols*, 7(5): 829-838 (2012).
Sandberg et al. "BIOMED-2 Multiplex lmmunoglobulin/T-Cell Receptor Polymerase Chain Reaction Protocols Can Reliably Replace Southern Blot Analysis in Routine Clonality Diagnostics", *J. Molecular Diagnostics*, 7(4): 495-503 (2005).
Sandberg, et al. "Capturing whole-genome characteristics in short sequences using a naïve Bayesian classifier", *Genome Res.*, 11(8): 1404-9 (2001).
Santalucia, Jr., J. "Physical Principles and Visual-OMP Software for Optimal PCR Design," *Methods in Molecular Biology*, 402(PCR Primer Design):3-33, 40 pages (2007).
Santamaria, P. et al. "Beta-Cell-Cytotoxic CD8 T Cells from Nonobese Diabetic Mice Use Highly Homologous T Cell Receptor a-Chain CDR3 Sequences", *The Journal of Immunology*, 154(5):2494-2503 (1995).
Sartorius Stedim Biotech product brochure, "Primer removal after a PCR reaction with Vivacon® 2", (2010).
Sato et al. "Intraepithelial CD8+ tumor-infiltrating lymphocytes and a high CD8+/regulatory T cell ratio are associated with favorable prognosis in ovarian cancer", *PNAS*, 102(51): 18538-18543 (2005). Epub Dec. 12, 2005.
Satoh et al. "Pretreatment with restriction enzyme or bovine serum albumin for effective PCR amplification of Epstein-Barr virus DNA in DNA extracted from paraffin-embedded gastric carcinoma tissue", *J Clin Microbiol.*, 36(11): 3423-3425 (1998).
Schaufelberger et al. "An uneven expression of T cell receptor V genes in the arterial wall and peripheral blood in giant cell arteritis", *Inflammation*, 31(6):372-383 (2008).
Schlissel, M.S. et al. "Leukemia and lymphoma: a cost of doing business for adaptive immunity", *Genes Dev.*, 20(12): 1539-1544 (2006).
Schloss, PD et al. Reducing the Effects of PCR Amplification and Sequencing Artifacts on 16S Rrna-Based Studies. PLoS One. Dec. 14, 2011, vol. 6, No. 12; e27310; DOI: 1 0.1371/journal.pone. 002731 0.
Schøller et al. "Analysis of T cell receptor αβ variability in lymphocytes infiltrating melanoma primary tumours and metastatic lesions", *Cancer Immunol lmmunother*. 39(4):239-248 (1994).
Schreiber et al. "Cancer immunoediting: integrating immunity's roles in cancer suppression and promotion", *Science*, 331(6024): 1565-1570 (2011). doi: 10.1126/science.1203486.
Schwab et al. "CD8+ T-cell clones dominate brain infiltrates in Rasmussen encephalitis and persist in the periphery", *Brain*, 132:1236-1246 (2009).
Schweiger et al. "Genome-wide massively parallel sequencing of formaldehyde fixed-paraffin embedded (FFPE) tumor tissues for copy-number- and mutation-analysis", *PLoS One*, 4(5): e5548, 7 pages (2009). doi: 10.1371/journal.pone.0005548. Epub May 14, 2009.
Sebastian, E. et al., "Molecular Characterization of immunoglobulin gene rearrangements in diffuse large B-cell lymphoma", *Am. J. Pathol.*, 181: 1879-1888, Abstract (2012). (Epub: Sep. 28, 2012).
Sehouli et al. "Epigenetic quantification of tumor-infiltrating T-lymphocytes" *Epigenetics*, 6(2): 236-246 (2011). Epub Feb. 1, 2011.
Seitz, et al. "Reconstitution of paired T cell receptor α- and β-chains from microdissected single cells of human inflammatory tissues", *PNAS*, 103: 12057-12062 (2006).

Seo, et al. "Four-color DNA sequencing by synthesis on a chip using photocleavable fluorescent nucleotides", *PNAS*, 102(17): 5926-5931 (2005). Epub Apr. 13, 2005.
Sequenta and iRepertoire Join Forces on Blood Cancer Testing. Business Wire. Aug. 8, 2013. http://www.businesswire.com/news/home/20130808005363/en/SequentaiRepertoire-Join-Forces-Blo . . . .#.VGTT9WdOyUk. 2 pages.
Sfanos et al. "Human Prostate-Infiltrating CD8+ T Lymphocytes are Oligoclonal and Pd-1+", *The Prostate*, 69(15): 1694-1703 (2009).
Sfanos et al. "Phenotypic analysis of prostate-infiltrating lymphocytes reveals TH17 and Treg skewing", *Clinical Cancer Research*, 14(11):3254-3261 (2008). doi: 10.1158/1078-0432.CCR-07-5164.
Shen et al. "Comparing platforms for *C. elegans* mutant identification using high-throughput whole-genome sequencing", *PLoS One*, 3(12):e4012, 6 pages (2008).
Shendure, et al. "Accurate multiplex polony sequencing of an evolved bacterial genome", *Science*, 309(5741): 1728-1732, Abstract Only (2005). Epub Aug. 4, 2005.
Shendure, et al. "Advanced sequencing technologies: methods and goals", *Nat Rev Genet.*, 5(5): 335-344 (2004).
Sherwood, et al. "New Technologies for Measurements of Tumor Infiltrating Lymphocytes", Presented Nov. 7, 2012 Moscone Center, Exhibit Halls ABC.
Sherwood, et al. "Tumor-infiltrating lymphocytes in colorectal tumors display a diversity of T cell receptor sequences that differ from the T cells in adjacent mucosal tissue", Cancer Immunol Immunother., 62(9):1453-61 (2013). doi: 10.1007/s00262-013-1446-2. Epub Jun. 16, 2013.
Shino, et al. "Usefulness of immune monitoring in lung transplantation using adenosine triphosphate production in activated lymphocytes", *The Journal of Heart and Lung Transplant*, 31: 996-1002 (2012).
Shumaker, et al. "Mutation detection by solid phase primer extension", *Hum Mutat.*, 7(4): 346-354, Abstract Only (1996).
Sia, et al. "Microfluidic devices fabricated in poly(dimethylsiloxane) for biological studies", *Electrophoresis*, 24(21): 3563-3576, Abstract Only (2003).
Sims, et al. "Fluorogenic DNA sequencing in PDMS microreactors", *Nat Methods*, 8(7): 575-580 (2011). doi: 10.1038/nmeth.1629.
Sims, et al. "MHC-peptide tetramers for the analysis of antigen-specific T cells", *Expert Rev Vaccines*, 9(7): 765-774 (2010). doi: 10.1586/erv.10.66.
Singapore Application No. 11201403212R, Written Opinion dated Mar. 27, 2015, 12 pges.
Singapore Application No. 11201407888R, Written Opinion dated Aug. 14, 2015, 12 pages.
Singapore Application No. 11201500313Y, Search Report and Written Opinion dated Dec. 9, 2015, 11 pages.
Skulina et al. "Multiple Sclerosis: Brain-infiltrating CD8+ T cells persist as clonal expansions in the cerebrospinal fluid and blood", *PNAS*, 101(8):2428-2433 (2004).
Slightom, J.L. et al. "*Homo sapiens* germline beta T-cell receptor locus", NCBI Accession No. L36092 NCBI, 254 pages (2009) Retrieved from the Internet: <URL:http://www.ncbi.nlm.nih.gov/nuccore/L36092>.
Smith, et al. "Comparison of biosequences", *Advances in Applied Mathematics*, 2: 482-489 (1981).
Smith et al. "Rapid generation of fully human monoclonal antibodies specific to a vaccinating antigen", *Nature Protocols*, 4(3): 372-384 and CORRIGENDA (2009).
Smith et al. "Rapid whole-genome mutational profiling using next-generation sequencing technologies", *Genome Research*, 18: 1638-1642 (2008).
Smith et al, "Using quality scores and longer reads improves accuracy of Solexa read mapping," BMC Bioinformatics, 9: 128 (2008).
Sobrino, et al. "SNPs in forensic genetics: a review on SNP typing methodologies", *Forensic Sci Int.*, 154(2-3): 181-194, Abstract Only (2005). Epub Jan. 11, 2005.
Spreafico, et al. "A circulating reservoir of pathogenic-like CD4+ T cells shares a genetic and phenotypic signature with the inflamed synovial micro-environment", *Ann Rheum Dis.*, 0: 1-7 (2014). doi: 10.1136/annrheumdis-2014-206226. [Epub ahead of print].

(56) References Cited

OTHER PUBLICATIONS

Sramkova, et al. "Detectable minimal residual disease before allogeneic hematopoietic stem cell transplantation predicts extremely poor prognosis in children with acute lymphoblastic leukemia", *Pediatr. Blood Cancer*, 48(1):93-100 (2007).
Srinivasan et al. "Effect of fixatives and tissue processing on the content and integrity of nucleic acids", *Am J Pathol.*, 161(6): 1961-1971 (2002).
Srivastava and Robins. "Palindromic nucleotide analysis in human T cell receptor rearrangements", PLoS One, 7(12):e52250 (2012). doi: 10.1371/journal.pone.0052250. Epub Dec. 21, 2012.
Standard Sequencing Primers, Max Planck Genome Center Cologne, Jan. 15, 2011, 2 pages, downloaded from https://genomecentre.mpipz.mpg.de/SeqOrderDB/export/sequencing-primers.html.
Stanley. Essentials of Immunology & Serology, Delmar, Thomson Learning, Chapter 7, T cells, p. 95 (2002).
Steenbergen, et al. "Distinct ongoing Ig heavy chain rearrangement processes in childhood B-precursor acute lymphoblastic leukemia", *Blood*, 82(2):581-589 (1993).
Steenbergen, et al. "Frequent ongoing T-cell receptor rearrangements in childhood B-precursor acute lymphoblastic leukemia: implications for monitoring minimal residual disease", *Blood*, 86(2): 692-702, Abstract Only (1995).
Stein and Nombela-Arrieta. "Chemokine control of lymphocyte trafficking: a general overview", *Immunology*, 116(10):1-12 (2005).
Steinmetz, O.M. et al. "Chemokines and B cells in renal inflammation and allograft rejection", *Frontiers in Bioscience (Schol. Ed.)*, 1:13-22 (2009).
Stemmer, et al. "Single-step assembly of a gene and entire plasmid from large numbers of oligodeoxyribonucleotides", *Gene*, 164(1): 49-53 (1995).
Steward et al. "A polymerase chain reaction study of the stability of Ig heavy-chain and T-cell receptor delta gene rearrangements between presentation and relapse of childhood B-lineage acute lymphoblastic leukemia", *Blood*, 83(5):1355-1362 (1994).
Stewart and Schwartz. "Immunoglobulin V regions and the B cell", *Blood*, 83(7): 1717-1730 (1994).
Stickler, et al. "An in vitro human cell-based assay to rank the relative immunogenicity of proteins", *Toxicol Sci.*, 77(2): 280-289 (2004). Epub Dec. 22, 2003.
Straten, Per thor, et al. "T-cell clonotypes in cancer", *Journal of Translational Medicine*, 2(1): 11, 10 pages (2004).
Stratton. "Exploring the genomes of cancer cells: progress and promise", *Science*, 331(6024): 1553-1558 (2011). doi: 10.1126/science.1204040.
Striebich, et al. "Selective Accumulation of Related CD41 T Cell Clones in the Synovial Fluid of Patients with Rheumatoid Arthritis", *J Immunol.*, 161(8): 4428-36 (1998).
Struyk et al. "T cell receptors in rheumatoid arthritis", *Arthritis & Rheumatism*, 38(5):577-589 (1995).
Sumida et al. "T cell receptor repertoire of infiltrating T cells in lips of Sjögren's syndrome patients", *J Clin Invest.*, 89:681-685 (1992).
Sumida et al. "T cell receptor Vα repertoire of infiltrating T cells in labial salivary glands from patients with Sjögren's syndrome", *J Rheumatol.*, 21:1655-1661 (1994).
Swarup and Rajeswari. "Circulating (cell-free) nucleic acids--a promising, non-invasive tool for early detection of several human diseases", *FEBS Letters*, 581(5): 795-799 (2007). Epub Feb. 2, 2007.
Szczepanski et al. "Why and how to quantify minimal residual disease in acute lymphoblastic leukemia'?", *Leukemia*, 21(4):622-626 (2007). Epub Feb. 15, 2007.
Szereday et al., "Somatic Mutation of the 5' Noncoding Region of the BCL-6 Gene Is Associated with Intraclonal Diversity and Clonal Selection in Histological Transformation of Follicular Lymphoma", *The American Journal of Pathology*, 156(3): 1017-1024 (2000).
Tackenberg et al. "Clonal expansions of CD4+ β helper T cells in autoimmune myasthenia gravis", *European Journal of Immunology*, 37(3):849-863 (2007).

Tajiri et al. "Cell-microarray analysis of antigen-specific B-cells: single cell analysis of antigen receptor expression and specificity", *Cytometry Part A*, 71A: 961-967 (2007).
Takamatsu, et al., "A comparison between next-generation sequencing and ASO-qPCR for minimal residual disease detection in multiple myeloma", *J. Clin. Oncol.*, 31(Supplement 1): Abstract 8601 (Conference Abstract), Entire Abstract (2013).
Tanaka et al. "Single-Cell Analysis of T-Cell Receptor Repertoire of HTLV-1 Tax-Specific Cytotoxic T Cells in Allogeneic Transplant Recipients with Adult T-Cell Leukemia/Lymphoma", *Cancer Research*, 70: 6181-6192 (2010).
Taubenheim et al. "High Rate of Antibody Secretion Is not Integral to Plasma Cell Differentiation as Revealed by Xbp-1 Deficiency", *The Journal of Immunology*, 189: 3328-3338 (2012).
Tautz, et al. "Cryptic simplicity in DNA is a major source of genetic variation", *Nature*, 322(6080): 652-656 (1986).
Tawfik, et al. "Man-made cell-like compartments for molecular evolution", *Nat Biotechnol.*, 16(7): 652-656, Abstract Only (1998).
ten Bosch et al. "Keeping Up With the Next Generation Massively Parallel Sequencing in Clinical Diagnostics", *Journal of Molecular Diagnostics*, 10(6): 484-492 (2008).
Thiel, et al. "Antigen-specific cytometry—new tools arrived!", *Clin Immunol.*, 111(2): 155-161, Abstract Only (2004).
Thornhill et al. "A comparison of different lysis buffers to assess allele dropout from single cells for preimplantation genetic diagnosis", *Prenatal Diagnosis*, 21:490-497 (2001).
Toinoven et al. "Islet-associated T-cell receptor-β CDR sequence repertoire in prediabetic NOD mice reveals antigen-driven T-cell expansion and shared usage of Vβ Jβ TCR chains", Mol Immunol., 64(1):127-35 (2015). doi: 10.1016/j.molimm.2014.11.009. Epub Dec. 3, 2014.
Tokimitsu et al. "Single lymphocyte analysis with a microwell array chip", *Cytometry Part A*, 71A:1003-1010 (2007).
Toriello et al. "Integrated microfluidic bioprocessor for single-cell gene expression analysis", *PNAS*, 105(51): 20173-20178 (2008).
Triebel, F. et al. "A Unique V-J-C-Rearranged Gene Encodes a γ Protein Expressed on the Majority of CD3+ T Cell Receptor -a/fr Circulating Lymphocytes", *J. Exp. Med.*, 167:694-699 (1988).
Tsai et al. "Discovery of rare mutations in populations: TILLING by sequencing", Plant Physiology, 156(3): 1257-1268 (and Supplemental Data) (2011).
Tsankova, et al. "Peripheral T-cell lymphoma emerging in a patient with aggressive polymyositis: molecular evidence for neoplastic transformation of an oligo clonal T-cell infiltrate", Acta Neuropathol., 126(4):595-601 (2013). doi: 10.1007/s00401-013-1164-z. Epub Aug. 13, 2013.
Tschumper, et al. "Comprehensive assessment of potential multiple myeloma immunoglobulin heavy chain V-D-J intraclonal variation using massively parallel pyrosequencing", *Oncotarget*, 3(4): 502-513 (2012).
Tumeh et al. "PD-1 blockade induces responses by inhibiting adaptive immune resistance", Nature, 515: 568-571 (2014). doi:10.1038/nature13954.
Turcotte and Rosenberg. "Immunotherapy for metastatic solid cancers", *Adv Surg.*, 45: 341-360 (2011).
UK combined search and examination report dated Mar. 20, 2013 for GB 1300533.5.
UK Combined Search Report and Office action dated Jun. 29, 2012 for UK application No. GB1209668.1.
UK Combined Search Report and Office action dated May 27, 2011 for UK application No. GB1105068.9.
UK Search Report and office action dated Jan. 13, 2012 for UK application No. GB1120209.0.
UK Search Report and office action dated Jul. 7, 2010 for UK application No. GB1009641.0.
Umibe et al. "Clonal expansion of T cells infiltrating in the airways of non-atopic asthmatics", *Clinical & Experimental Immunology*, 119(3):390-397 (2000).
Unrau and Deugau. "Non-cloning amplification of specific DNA fragments from whole genomic DNA digests using DNA 'indexers'", *Gene.*, 145(2): 163-169, Abstract Only, 2 pages (1994).

(56) References Cited

OTHER PUBLICATIONS

Uppaluri et al. "Focus on TILs: prognostic significance of tumor infiltrating lymphocytes in head and neck cancers", *Cancer Immunity*, 8:16, 10 pages (2008).
Urban, et al. "A systematic and quantitative analysis of PCR template contamination", *J Forensic Sci.*, 45(6): 1307-1311 (2000).
Urquhart, et al. "Rate-controlled delivery systems in drug and hormone research", *Annu Rev Pharmacol Toxicol.*, 24: 199-236, Abstract Only (1984).
Van Der Velden, V.H.J., et al. "Optimization of PCR-based minimal residual disease diagnostics for childhood acute lymphoblastic leukemia in a multi-center setting," *Leukemia*, 21:706-713 (2007).
Vanderborght, et al. "Dynamic T cell receptor clonotype changes in synovial tissue of patients with early rheumatoid arthritis: effects of treatment with cyclosporin A (Neoral)", *J Rheumatol.*, 29(3): 416-426 (2002).
Venturi, et al. "A mechanism for TCR sharing between T cell subsets and individuals revealed by pyrosequencing", *J Immunol.*, 186(7): 4285-4294 (2011). doi: 10.4049/jimmunol.1003898. Epub Mar. 7, 2011.
Venturi, V. et al. "TCR β-Chain Sharing in Human CD8+ T Cell Responses to Cytomegalovirus and EBV[1]", *The Journal of Immunology*, 181:7853-7862 (2008).
Venturi, V. et al. "The molecular basis for public T-cell responses?", *Nature Reviews*, 8:231-238 (2008).
Verhagen, O.J.H.M., et al. "Application of germline IGH probes in real-time quantitative PCR for the detection of minimal residual disease in acute lymphoblastic leukemia", *Leukemia*, 14:1426-1435 (2000).
Vester, et al. "LNA (locked nucleic acid): high-affinity targeting of complementary RNA and DNA", *Biochemistry*, 43(42): 13233-13241, Abstract Only (2004).
Vlassov, et al. "Circulating nucleic acids as a potential source for cancer biomarkers", *Curr Mol Med.*, 10(2): 142-165 (2010).
Vogelstein et al. "Cancer genome landscapes", *Science*, 339(6127): 1546-1558 (2013). doi: 10.1126/science.1235122.
Vogelstein and Kinzler. "Digital PCR," *Genetics, PNAS*, 96:9236-9241 (1999).
Wälchli, et al. "A practical approach to T-cell receptor cloning and expression", *PLoS One*, 6(11): e27930, 11 pages (2011). doi: 10.1371/journal.pone.0027930. Epub Nov. 21, 2011.
Wang, et al. "Balanced-PCR amplification allows unbiased identification of genomic copy changes in minute cell and tissue samples", *Nucleic Acids Research*, 32(9): e76, 10 pages (2004).
Wang, et al. "HIV integration site selection: Analysis by massively parallel pyrosequencing reveals association with epigenetic modifications", Genome Research, 17(8): 1186-1194 (2007). Epub Jun. 1, 2007.
Wang et al. "Immunorepertoire analysis by multiplex PCR amplification and high throughput sequencing", Poster-Program 42.6, The 96th Annual Meeting of the America Association of Immunologists, Seattle, USA, May 8-12, 2009, 1 page.
Wang, X. et al. "Quantitative Measurement of Pathogen Specific Human Memory T Cell Repertoire Diversity using a CDR3 B-Specific Microarray", *BMC Genomics*, 8(329): 1-13 (2007).
Ward and Marelli-Berg. "Mechanisms of chemokine and antigen-dependent T-lymphocyte navigation", *Biochem. J.*, 418:13-27 (2009).
Weinstein, J.A. et al. "High-Throughput Sequencing of the Zebrafish Antibody Repertoire", *Science*, 324(5928): 807-810, Supporting/Supplementary Materials (2009).
Weiss et al. "Clonal Rearrangements of T-Cell Receptor Genes in Mycosis Fungoides and Dermatopathic Lymphadenopathy", *The New England Journal of Medicine*, 313(9):539-544 (1985).
Welch and Link. "Genomics of AML: clinical applications of next-generation sequencing", *American Society of Hematology*, 2011: 30-35 (2011). doi: 10.1182/asheducation-2011.1.30.
Wells, et al. "Rapid evolution of peptide and protein binding properties in vitro", *Curr Opin Biotechnol.*, 3(4): 355-362, Abstract Only (1992).

Wells, et al. "Strategies for preimplantation genetic diagnosis of single gene disorders by DNA amplification", *Prenatal Diagnosis*, 18(13):1389-1401 (1998).
Weng, Wen-Kai et al., "Graft-Versus-Lymphoma Effect After Non-Myeloablative Allogeneic Transplant Induces Molecular Remission Assessed by High-Throughput Sequencing of T Cell Receptor in Patients with Advanced Stage Mycosis Fungoides and Sezary Syndrome", Blood, vol. 118. No. 21. Nov. 2011 (Nov. 2011). p. 1346. XP055213326. & 53rd Annual Meeting and Exposition of the American-Society-of-Hematology (ASH); San Diego. CA. USA; Dec. 10-13, 2011.
Weng, et al. "Minimal residual disease monitoring with high-throughput sequencing of T cell receptors in cutaneous T cell lymphoma", Sci Transl Med., 5(214):214ra171 (2013). doi: 10.1126/scitranslmed.3007420.
Westermann and Pabst. "Distribution of lymphocyte subsets and natural killer cells in the human body", *Clin Investig.*, 70(7): 539-544 (1992).
Wetmur and Chen. "An emulsion polymerase chain reaction-based method for molecular haplotyping", *Methods in Molecular Biology*, 410: 351-361 (1996).
Wetmur and Chen. "Linking emulsion PCR haplotype analysis", chapter 11, Park, D.J. (ed.), *PCR Protocols, Methods in Molecular Biology*, 687: 165-175 (2011).
Wetmur et al. "Molecular haplotyping by linking emulsion PCR: analysis of paraoxonase 1 haplotypes and phenotypes", *Nucleic Acids Research*, 33(8):2615-2619 (2005).
Weusten, et al. "Principles of quantitation of viral loads using nucleic acid sequence-based amplification in combination with homogeneo detection using molecular beacons", Nucleic Acids Res., 30(6): e26, 7 pages (2002).
White et al. "High-throughput microfluidic single-cell RT-qPCR", *PNAS*, 108(34): 13999-14004 (2011).
Whiteford, et al. "Swift: primary data analysis for the Illumina Solexa sequencing platform", *Bioinformatics*, 25(17): 2194-2199 (2009). doi: 10.1093/bioinformatics/btp383. Epub Jun. 23, 2009.
Williams, et al. "Amplification of complex gene libraries by emulsion PCR", *Nat Methods*, 3(7): 545-550 (2006).
Wolda. "Similarity Indices, Sample Size and Diversity", *Oecologia* (Berl), 50:296-302 (1981).
Wolfl, et al. "Activation-induced expression of CD137 permits detection, isolation, and expansion of the full repertoire of CD8+ T cells responding to antigen without requiring knowledge of epitope specificities", *Blood*, 110(1): 201-210 (2007). Epub Mar. 19, 2007.
Wolfl, et al. "Use of CD137 to study the full repertoire of CD8+ T cells without the need to know epitope specificities", *Cytometry A.*, 73(11): 1043-1049 (2008). doi: 10.1002/cyto.a.20594.
Wood, et al. "Using next-generation sequencing for high resolution multiplex analysis of copy number variation from nanogram quantities of DNA from formalin-fixed paraffin-embedded specimens", *Nucleic Acids Research*, 38(14): e151, 11 pages (2010). doi: 10.1093/nar/gkq510. Epub Jun. 4, 2010.
Wrammert et al. "Rapid cloning of high-affinity human monoclonal antibodies against influenza virus", *Nature*, 453: 667-672 (2008).
Wu, et al. "High-throughput sequencing detects minimal residual disease in acute T lymphoblastic leukemia", Sci Transl Med., 4(134):134ra63 (2012). doi: 10.1126/scitranslmed.3003656.
Wu, et al. "High-throughput sequencing of T-cell receptor gene loci for minimal residual disease monitoring in T Lymphoblastic Leukemia", Blood, 118: 2545 (Abstr) (2011).
Wu, et al., "Detection of Minimal Residual Disease in B Lymphoblastic Leukemia by High-Throughput Sequencing of IGH", Clin Cancer Res., 20(17): 4540-8 (2014). Published OnlineFirst Jun. 26, 2014; doi: 10.1158/1078-0432.CCR-13/3231.
Wu, Y-C. et al. "High-throughput immunoglobulin repertoire analysis distinguishes between human IgM memory and switched memory B-cell populations", *Blood Journal*, 116(7): 1070-1078, 22 pages (2010).
Wu et al. "Focused Evolution of HIV-1 Neutralizing Antibodies Revealed by Structures and Deep Sequencing", *Science*, 333: 1593-1602 (2011).

(56) References Cited

OTHER PUBLICATIONS

Wu, H.D. et al. "The Lymphocytic Infiltration in Calcific Aortic Stenosis Predominantly Consists of Clonally Expanded T Cells", *The Journal of Immunology*, 178(8): 5329-5339 (2007).
Xiong, et al. "Chemical gene synthesis: strategies, softwares, error corrections, and applications", *FEMS Microbiol Rev.*, 32(3): 522-540 (2008). doi: 10.1111/j.1574-6976.2008.00109.x. Epub Apr. 2, 2008.
Xiong, et al. "Non-polymerase-cycling-assembly-based chemical gene synthesis: strategies, methods, and progress", *Biotechnol Adv.*, 26(2): 121-134, Abstract Only (2008). Epub Nov. 7, 2007.
Xu, et al. "Simultaneous isolation of DNA and RNA from the same cell population obtained by laser capture microdissection for genome and transcriptome profiling", *J Mol Diagn.*, 10(2):129-134 (2008). doi: 10.2353/jmoldx.2008.070131. Epub Feb. 7, 2008.
Yan et al. "Emergence of a STAT3 Mutated NK Clone in LGL Leukemia", Leuk Res Rep., 4(1):4-7 (2014). doi: 10.1016/j.lrr.2014.12.001. eCollection 2015.
Yao, et al. "Analysis of the CDR3 length repertoire and the diversity of TCRα chain in human peripheral blood T Lymphocytes", Cell Mol Immunol., 4(3): 215-220 (2007).
Yeh, et al. "Regulating DNA translocation through functionalized soft nanopores", *Nanoscale*, 4(8): 2685-4693, Abstract Only (2012). doi: 10.1039/c2nr30102d. Epub Mar. 15, 2012.
Yassai, M.B. et al. "A clonotype nomenclature for T cell receptors", *Immunogenetics*, 61:493-502 (2009).
Yin et al. "Antiretroviral therapy restores diversity in the T-cell receptor Vβ repertoire of CD4 T-cell subpopulations among human immunodeficiency virus type 1-infected children and adolescents", *Clinical and Vaccine Immunology*, 16(9):1293-1301 (2009).
Yon and Fried. "Precise gene fusion by PCR", *Nucleic Acids Research*, 17(12):4895, 1 page (1989).
York, et al. "Highly parallel oligonucleotide purification and functionalization using reversible chemistry", *Nucleic Acids Res.*, 40(1): e4, 7 pages (2012). doi: 10.1093/nar/gkr910. Epub Oct. 29, 2011.
Yu and Fu. "Tumor-infiltrating T lymphocytes: friends or foes?", *Lab Invest.*, 86(3): 231-245 (2006).
Zagnoni, et al. "Droplet Microfluidics for High-throughput Analysis of Cells and Particles", *Methods in Cell Biology*, Chapter 2, 102: 23-48 (2011).
Zaliova, et al. "Quantification of fusion transcript reveals a subgroup with distinct biological properties and predicts relapse in BCR/ABL-positive ALL: implications for residual disease monitoring", *Leukemia*, 23(5):944-951 (2009).
Zehentner et al. "Minimal Disease Detection and Confirmation in Hematologic Malignancies: Combining Cell Sorting with Clonality Profiling", *Clinical Chemistry*, 52(3): 430-437 (2006).
Zeng et al. "High-performance single cell genetic analysis using microfluidic emulsion generator arrays", *Anal. Chem.*, 82(8):3183-3190 (2010).
Zhong, Q. et al. "Multiplex digital PCR: breaking the one target per color barrier of quantitative PCR", Lab Chip, 11:2167-2174 (2011).
Zhou et al. "Isolation of purified and live Foxp3+ regulatory T cells using FACS sorting on scatter plot", *J Mol Cell Biol.*, 2(3): 164-169 (2010). doi: 10.1093/jmcb/mjq007. Epub Apr. 29, 2010.
Zhu, et al. "Immune surveillance by CD8αα+ skin-resident T cells in human herpes virus infection", Nature, 497(7450):494-7 and Corrigendum (2013). doi: 10.1038/nature12110. Epub May 8, 2013.
Zimmerman and Mannhalter. "Technical aspects of quantitative competitive PCR", *Biotechniques*, 21: 268-279 (1996).
Andersen, N.S. et al., "Failure of immunologic purging in mantle cell lymphoma assessed by polymerase chain reaction detection of minimal residual disease." Blood, 90(10): 4212-4221 (1997).
European Patent Application No. 13847123.0, Extended European Search Report dated May 31, 2016, 9 pages.
European Patent Application No. 13848896.0, Extended European Search Report dated Jun. 7, 2016, 10 pages.
European Patent Application No. 13846484.7, Extended European Search Report dated May 20, 2016, 5 pages.
Ferrero, et al., "Minimal residual disease detection in lymphoma and multiple myeloma: impact on therapeutic paradigms." Hematological Oncology, 29(4): 167-176 (2011).
Kurokawa et al., "Complementarity determining region-III is a useful molecular marker for the evaluation of minimal residual disease in mantle cell lymphoma." British Journal of Haematology, 98(2): 408-412 (1997).
Pott, C., "Minimal residual disease detection in mantle cell lymphoma: technical aspects and clinical relevance." Seminars in Hematology, 48(3): 172-184 (2011).
Pott, C., "Structure of Bcl-1 and IgH-CDR3 rearrangements as clonal markers in mantle cell lymphomas." Leukemia, 12(10): 1630-1637 (1998).
Davies et al., "Transformation of follicular lymphoma to diffuse large B-cell lymphoma proceeds by distinct oncogenic mechanisms", Br J Haematol., 136(2):286-93 (2007).
PCT/US2012/061977, International Search Report and Written Opinion dated Feb. 25, 2013, 11 pages.
Brody, J.D., "Immunotransplant for mantle cell lymphoma: Phase I/II study preliminary results." International Conference & Exhibition on Cell Science & Stem Cell Research, J Cell Sci Ther (2011); 2(4): 96.
European Patent Application No. 14754622.0, Partial Supplementary European Search Report dated Sep. 29, 2016, 7 pages.
European Patent Application No. 14754622.0, Extended European Search Report dated Jan. 12, 2017, 12 pages.
Faham, M.C., et al. "Increased T Cell Receptor Clonotype Sharing Among Ankylosing Spondylitis Patients Revealed by Deep Repertoire Sequence Analysis." Arthritis & Rheumatism (2011), Abstract 1339, 63(10)Supplement: S524, 3 pages.
NCBI Blast search; SEQ ID No. 1 vs protein database; accessed Oct. 20, 2016, 15 pages.
NCBI Blast search; SEQ ID No. 2 vs protein database; accessed Oct. 20, 2016, 21 pages.
Pott, Christiane, et al. "Molecular remission is an independent predictor of clinical outcome in patients with mantle cell lymphoma after combined immunochemotherapy: a European MCL intergroup study." Blood (2010); 115.16: 3215-3223.
Chinese Patent Application No. 201510054401.X, Search Report dated Jul. 14, 2016, 2 pages.
Treviño, M.A., et al., "CD8+ T cells oligoclonally expanded in synovial fluid at onset of spondyloarthropathy selectively proliferate in response to self-antigens: characterization of cell specificities in nonclonal populations." Journal of Rheumatology (2004); 31(10): 1962-1972.
Winchester, Robert, et al. "Circulating activated and effector memory T cells are associated with calcification and clonal expansions in bicuspid and tricuspid valves of calcific aortic stenosis." The Journal of Immunology (2011); 187.2: 1006-1014.
Woodsworth, Daniel J., et al., "Sequence analysis of T-cell repertoires in health and disease." Genome Medicine (2013); 5: 98, 13 pages.

* cited by examiner

| ID | TCRB CDR3 Sequence | % | Vgene | J gene | SEQ ID NO: |
|---|---|---|---|---|---|
| PT 50 | TGTGCCAGCAGTTACTCCGCCGAAAATGAAAAACT | 99.5 | 6 | TRBJ1-4 | 774 |
| PT 44 | TGTGCCAGCAGCCCCGGTCGCAGCCAAGTGTCTGGGGCCAACGTCCT | 99.4 | 11 | TRBJ2-6 | 775 |
| PT 63 | TGTGCCAGCAGTTACTCGCGCTCCGAACCTAATGAGCA | 99.4 | 6 | TRBJ2-1 | 776 |
| PT 39 | TGTGCCAGCAGCTTAAGCGGGTACCTTAAAGAGACCCA | 98.9 | TRBV7-9 | TRBJ2-5 | 777 |
| PT 48 | TGCGCCAGCACCCCGAGAGGAGAGCGGGAGCCAGATACGCA | 98.8 | TRBV5-1 | TRBJ2-3 | 778 |
| PT 53 | TGCAGTGCTAGAGGGCCTATGTTCCGGGACCGATCCTCCTACGAGCA | 98.6 | TRBV20-1 | TRBJ2-7 | 779 |
| PT 7 | TGTGCCAGCAGCAAGATTTTACAGGTGCAGATTCTGGGGCCAACGTCCT | 98.5 | TRBV4-2 | TRBJ2-6 | 780 |
| PT 8 | TGTGCCAGCAGTGAATTGAAAGACGAGAAGGGTGGTTTTTTTGCCACTGAAGC | 98.5 | 2 | TRBJ1-1 | 781 |
| PT 9 | TGCGCCAGCAGCCAAGATAGAGAGCGGGAGGATCGCACAGATACGCA | 98.5 | TRBV4-1 | TRBJ2-3 | 782 |
| PT 52 | TGTCCAGTCATTACCCA | 97.3 | TRBV3-1 | TRBJ2-5 | 783 |
| PT 4 | TGTGCCAGCAGTTTATTAGGAGAGGAGACCCA | 96.2 | TRBV28 | TRBJ2-5 | 784 |
| PT 6 | TGTGCCAGCAGCTTTTGTCTGTCTGGGGCCAACGTCCT | 96 | TRBV5-4 | TRBJ2-6 | 785 |
| PT 51 | TGTGCCAGCAGTGAATACACAGGGGAAGC | 94.9 | TRBV2 | TRBJ1-1 | 786 |
| PT 59 | TGTGCCAGCAGCCTATTTACTAAAAGGGGTTGTTTGGATGAGCA | 93.6 | 7 | TRBJ2-1 | 787 |
| PT 49 | TGTGCCAGCAGTTTTCGAACTCTTTCCCCCGGGGGCGCAATTCGGCCCAAAAACATTCA | 93.4 | 12 | TRBJ2-4 | 788 |
| PT 41 | TGTGCCAGCAGTTCCACAGATACGCA | 92.9 | TRBV28 | TRBJ2-3 | 789 |

Fig. 4A

| ID | TCRB CDR3 Sequence | % | Vgene | J gene | SEQ ID NO: |
|---|---|---|---|---|---|
| PT 15 | TGTGCCAGCAGCCCTGACAGGGGACGAGCCTGGAAACAC | 90.5 | TRBV7-3 | TRBJ1-3 | 790 |
| PT 32 | TGTGCCAGCAGCCCACGGGCGGATAAAGATGAAAAACT | 89.1 | TRBV9 | TRBJ1-4 | 791 |
| PT 14 | TGTGCCAGCAGTTTGAACACAAACCGGCAGTGGGCGCGAGCTAACTATGGCTA | 88.7 | 5 | TRBJ1-2 | 792 |
| PT 1 | TGTGCCAGCATTATTTTAGGGTACCCTAAACTATGGCTA | 87.1 | TRBV2 | TRBJ1-2 | 793 |
| PT 66 | TGTGCCAGCAGTTACTCGCGCTCCGAACCTAATGAGCA | 86.9 | 6 | TRBJ2-1 | 794 |
| PT 65 | TGCAGTGCTAGAGATCTACTCCCCCTGGGGGGGACGCGTGGAAACACCAT | 84.0 | TRBV20-1 | TRBJ1-3 | 795 |
| PT 5 | TGTGCCAGTAGTCACCCTCACACAGATACGCA | 82.8 | TRBV19 | TRBJ2-3 | 796 |
| PT 2 | TGTGCCAGCAGTTACATTTCAGGCTTAACTATGGCTA | 80.9 | 6 | TRBJ2-7 | 797 |
| PT 36 | TGTGCCAGCAGTTTAATAACAGTTCTTCTCGGGGAGCT | 77.5 | 12 | TRBJ2-2 | 798 |
| PT 40 | TGTGCCAGCAGTGAAGGCGGGAGAGCGCTTGGGAGCA | 70.9 | TRBV2 | TRBJ2-1 | 799 |
| PT 61 | TGCAGTGCTAGAGAGGGTAAGAGACCCA | 62.6 | TRBV20-1 | TRBJ2-5 | 800 |
| PT 58 | TGTGCCAGCAGTTCCTATGACAGGGGATCCATTCAGCCCCA | 58.6 | 6 | TRBJ1-5 | 801 |
| PT 47 | TGTGCCAGCAGTGATGAAAGGCGGGGCTCCTACAATGAGCA | 58.4 | TRBV2 | TRBJ2-1 | 802 |
| PT 30 | TGTGCCAGCAGTCTAACCGGACAGCGGTATAATGAAAAACT | 49 | TRBV27 | TRBJ1-4 | 803 |
| PT 33 | TGTGCCAGCAGCTTATGGGAAACCGGGGAGCT | 39 | TRBV11-2 | TRBJ2-2 | 804 |

Fig. 4B

| TCRB V/J SET 1 | | TCRB V/J SET 2 | | TCRB V/J SET 3 | |
|---|---|---|---|---|---|
| SEQ ID NO:V | SEQ ID NO:J | SEQ ID NO:V | SEQ ID NO:J | SEQ ID NO:V | SEQ ID NO:J |
| 2921 | 2989 | 2921 | 2990 | 2921 | 2991 |
| 2922 | 2990 | 2922 | 2991 | 2922 | 2992 |
| 2923 | 2991 | 2923 | 2992 | 2923 | 2993 |
| 2924 | 2992 | 2924 | 2993 | 2924 | 2994 |
| 2925 | 2993 | 2925 | 2994 | 2925 | 2995 |
| 2926 | 2994 | 2926 | 2995 | 2926 | 2996 |
| 2927 | 2995 | 2927 | 2996 | 2927 | 2997 |
| 2928 | 2996 | 2928 | 2997 | 2928 | 2998 |
| 2929 | 2997 | 2929 | 2998 | 2929 | 2999 |
| 2930 | 2998 | 2930 | 2999 | 2930 | 3000 |
| 2931 | 2999 | 2931 | 3000 | 2931 | 3001 |
| 2932 | 3000 | 2932 | 3001 | 2932 | 2989 |
| 2933 | 3001 | 2933 | 2989 | 2933 | 2990 |
| 2934 | 2989 | 2934 | 2990 | 2934 | 2991 |
| 2935 | 2990 | 2935 | 2991 | 2935 | 2992 |
| 2936 | 2991 | 2936 | 2992 | 2936 | 2993 |
| 2937 | 2992 | 2937 | 2993 | 2937 | 2994 |
| 2938 | 2993 | 2938 | 2994 | 2938 | 2995 |
| 2939 | 2994 | 2939 | 2995 | 2939 | 2996 |
| 2940 | 2995 | 2940 | 2996 | 2940 | 2997 |
| 2941 | 2996 | 2941 | 2997 | 2941 | 2998 |
| 2942 | 2997 | 2942 | 2998 | 2942 | 2999 |
| 2943 | 2998 | 2943 | 2999 | 2943 | 3000 |
| 2944 | 2999 | 2944 | 3000 | 2944 | 3001 |
| 2945 | 3000 | 2945 | 3001 | 2945 | 2989 |
| 2946 | 3001 | 2946 | 2989 | 2946 | 2990 |
| 2947 | 2989 | 2947 | 2990 | 2947 | 2991 |

Fig. 9A

| TCRB V/J SET 1 | | TCRB V/J SET 2 | | TCRB V/J SET 3 | |
|---|---|---|---|---|---|
| SEQ ID NO:V | SEQ ID NO:J | SEQ ID NO:V | SEQ ID NO:J | SEQ ID NO:V | SEQ ID NO:J |
| 2948 | 2990 | 2948 | 2991 | 2948 | 2992 |
| 2949 | 2991 | 2949 | 2992 | 2949 | 2993 |
| 2950 | 2992 | 2950 | 2993 | 2950 | 2994 |
| 2951 | 2993 | 2951 | 2994 | 2951 | 2995 |
| 2952 | 2994 | 2952 | 2995 | 2952 | 2996 |
| 2953 | 2995 | 2953 | 2996 | 2953 | 2997 |
| 2954 | 2996 | 2954 | 2997 | 2954 | 2998 |
| 2955 | 2997 | 2955 | 2998 | 2955 | 2999 |
| 2956 | 2998 | 2956 | 2999 | 2956 | 3000 |
| 2957 | 2999 | 2957 | 3000 | 2957 | 3001 |
| 2958 | 3000 | 2958 | 3001 | 2958 | 2989 |
| 2959 | 3001 | 2959 | 2989 | 2959 | 2990 |
| 2960 | 2989 | 2960 | 2990 | 2960 | 2991 |
| 2961 | 2990 | 2961 | 2991 | 2961 | 2992 |
| 2962 | 2991 | 2962 | 2992 | 2962 | 2993 |
| 2963 | 2992 | 2963 | 2993 | 2963 | 2994 |
| 2964 | 2993 | 2964 | 2994 | 2964 | 2995 |
| 2965 | 2994 | 2965 | 2995 | 2965 | 2996 |
| 2966 | 2995 | 2966 | 2996 | 2966 | 2997 |
| 2967 | 2996 | 2967 | 2997 | 2967 | 2998 |
| 2968 | 2997 | 2968 | 2998 | 2968 | 2999 |
| 2969 | 2998 | 2969 | 2999 | 2969 | 3000 |
| 2970 | 2999 | 2970 | 3000 | 2970 | 3001 |
| 2971 | 3000 | 2971 | 3001 | 2971 | 2989 |
| 2972 | 3001 | 2972 | 2989 | 2972 | 2990 |
| 2973 | 2989 | 2973 | 2990 | 2973 | 2991 |
| 2974 | 2990 | 2974 | 2991 | 2974 | 2992 |
| 2975 | 2991 | 2975 | 2992 | 2975 | 2993 |
| 2976 | 2992 | 2976 | 2993 | 2976 | 2994 |
| 2977 | 2993 | 2977 | 2994 | 2977 | 2995 |
| 2978 | 2994 | 2978 | 2995 | 2978 | 2996 |

Fig. 9B

| TCRB V/J SET 1 | | | TCRB V/J SET 2 | | | TCRB V/J SET 3 | |
|---|---|---|---|---|---|---|---|
| SEQ ID NO:V | SEQ ID NO:J | | SEQ ID NO:V | SEQ ID NO:J | | SEQ ID NO:V | SEQ ID NO:J |
| 2979 | 2995 | | 2979 | 2996 | | 2979 | 2997 |
| 2980 | 2996 | | 2980 | 2997 | | 2980 | 2998 |
| 2981 | 2997 | | 2981 | 2998 | | 2981 | 2999 |
| 2982 | 2998 | | 2982 | 2999 | | 2982 | 3000 |
| 2983 | 2999 | | 2983 | 3000 | | 2983 | 3001 |
| 2984 | 3000 | | 2984 | 3001 | | 2984 | 2989 |
| 2985 | 3001 | | 2985 | 2989 | | 2985 | 2990 |
| 2986 | 2989 | | 2986 | 2990 | | 2986 | 2991 |
| 2987 | 2990 | | 2987 | 2991 | | 2987 | 2992 |
| 2988 | 2991 | | 2988 | 2992 | | 2988 | 2993 |

| TCRB V/J SET 4 | | | TCRB V/J SET 5 | | | TCRB V/J SET 6 | |
|---|---|---|---|---|---|---|---|
| SEQ ID NO:V | SEQ ID NO:J | | SEQ ID NO:V | SEQ ID NO:J | | SEQ ID NO:V | SEQ ID NO:J |
| 2921 | 2992 | | 2921 | 2993 | | 2921 | 2994 |
| 2922 | 2993 | | 2922 | 2994 | | 2922 | 2995 |
| 2923 | 2994 | | 2923 | 2995 | | 2923 | 2996 |
| 2924 | 2995 | | 2924 | 2996 | | 2924 | 2997 |
| 2925 | 2996 | | 2925 | 2997 | | 2925 | 2998 |
| 2926 | 2997 | | 2926 | 2998 | | 2926 | 2999 |
| 2927 | 2998 | | 2927 | 2999 | | 2927 | 3000 |
| 2928 | 2999 | | 2928 | 3000 | | 2928 | 3001 |
| 2929 | 3000 | | 2929 | 3001 | | 2929 | 2989 |
| 2930 | 3001 | | 2930 | 2989 | | 2930 | 2990 |
| 2931 | 2989 | | 2931 | 2990 | | 2931 | 2991 |
| 2932 | 2990 | | 2932 | 2991 | | 2932 | 2992 |
| 2933 | 2991 | | 2933 | 2992 | | 2933 | 2993 |
| 2934 | 2992 | | 2934 | 2993 | | 2934 | 2994 |
| 2935 | 2993 | | 2935 | 2994 | | 2935 | 2995 |
| 2936 | 2994 | | 2936 | 2995 | | 2936 | 2996 |
| 2937 | 2995 | | 2937 | 2996 | | 2937 | 2997 |

Fig. 9C

| TCRB V/J SET 4 | | TCRB V/J SET 5 | | TCRB V/J SET 6 | |
|---|---|---|---|---|---|
| SEQ ID NO:V | SEQ ID NO:J | SEQ ID NO:V | SEQ ID NO:J | SEQ ID NO:V | SEQ ID NO:J |
| 2938 | 2996 | 2938 | 2997 | 2938 | 2998 |
| 2939 | 2997 | 2939 | 2998 | 2939 | 2999 |
| 2940 | 2998 | 2940 | 2999 | 2940 | 3000 |
| 2941 | 2999 | 2941 | 3000 | 2941 | 3001 |
| 2942 | 3000 | 2942 | 3001 | 2942 | 2989 |
| 2943 | 3001 | 2943 | 2989 | 2943 | 2990 |
| 2944 | 2989 | 2944 | 2990 | 2944 | 2991 |
| 2945 | 2990 | 2945 | 2991 | 2945 | 2992 |
| 2946 | 2991 | 2946 | 2992 | 2946 | 2993 |
| 2947 | 2992 | 2947 | 2993 | 2947 | 2994 |
| 2948 | 2993 | 2948 | 2994 | 2948 | 2995 |
| 2949 | 2994 | 2949 | 2995 | 2949 | 2996 |
| 2950 | 2995 | 2950 | 2996 | 2950 | 2997 |
| 2951 | 2996 | 2951 | 2997 | 2951 | 2998 |
| 2952 | 2997 | 2952 | 2998 | 2952 | 2999 |
| 2953 | 2998 | 2953 | 2999 | 2953 | 3000 |
| 2954 | 2999 | 2954 | 3000 | 2954 | 3001 |
| 2955 | 3000 | 2955 | 3001 | 2955 | 2989 |
| 2956 | 3001 | 2956 | 2989 | 2956 | 2990 |
| 2957 | 2989 | 2957 | 2990 | 2957 | 2991 |
| 2958 | 2990 | 2958 | 2991 | 2958 | 2992 |
| 2959 | 2991 | 2959 | 2992 | 2959 | 2993 |
| 2960 | 2992 | 2960 | 2993 | 2960 | 2994 |
| 2961 | 2993 | 2961 | 2994 | 2961 | 2995 |
| 2962 | 2994 | 2962 | 2995 | 2962 | 2996 |
| 2963 | 2995 | 2963 | 2996 | 2963 | 2997 |
| 2964 | 2996 | 2964 | 2997 | 2964 | 2998 |
| 2965 | 2997 | 2965 | 2998 | 2965 | 2999 |
| 2966 | 2998 | 2966 | 2999 | 2966 | 3000 |
| 2967 | 2999 | 2967 | 3000 | 2967 | 3001 |
| 2968 | 3000 | 2968 | 3001 | 2968 | 2989 |

Fig. 9D

| TCRB V/J SET 4 | | TCRB V/J SET 5 | | TCRB V/J SET 6 | |
|---|---|---|---|---|---|
| SEQ ID NO:V | SEQ ID NO:J | SEQ ID NO:V | SEQ ID NO:J | SEQ ID NO:V | SEQ ID NO:J |
| 2969 | 3001 | 2969 | 2989 | 2969 | 2990 |
| 2970 | 2989 | 2970 | 2990 | 2970 | 2991 |
| 2971 | 2990 | 2971 | 2991 | 2971 | 2992 |
| 2972 | 2991 | 2972 | 2992 | 2972 | 2993 |
| 2973 | 2992 | 2973 | 2993 | 2973 | 2994 |
| 2974 | 2993 | 2974 | 2994 | 2974 | 2995 |
| 2975 | 2994 | 2975 | 2995 | 2975 | 2996 |
| 2976 | 2995 | 2976 | 2996 | 2976 | 2997 |
| 2977 | 2996 | 2977 | 2997 | 2977 | 2998 |
| 2978 | 2997 | 2978 | 2998 | 2978 | 2999 |
| 2979 | 2998 | 2979 | 2999 | 2979 | 3000 |
| 2980 | 2999 | 2980 | 3000 | 2980 | 3001 |
| 2981 | 3000 | 2981 | 3001 | 2981 | 2989 |
| 2982 | 3001 | 2982 | 2989 | 2982 | 2990 |
| 2983 | 2989 | 2983 | 2990 | 2983 | 2991 |
| 2984 | 2990 | 2984 | 2991 | 2984 | 2992 |
| 2985 | 2991 | 2985 | 2992 | 2985 | 2993 |
| 2986 | 2992 | 2986 | 2993 | 2986 | 2994 |
| 2987 | 2993 | 2987 | 2994 | 2987 | 2995 |
| 2988 | 2994 | 2988 | 2995 | 2988 | 2996 |

| TCRB V/J SET 7 | | TCRB V/J SET 8 | | TCRB V/J SET 9 | |
|---|---|---|---|---|---|
| SEQ ID NO:V | SEQ ID NO:J | SEQ ID NO:V | SEQ ID NO:J | SEQ ID NO:V | SEQ ID NO:J |
| 2921 | 2995 | 2921 | 2996 | 2921 | 2997 |
| 2922 | 2996 | 2922 | 2997 | 2922 | 2998 |
| 2923 | 2997 | 2923 | 2998 | 2923 | 2999 |
| 2924 | 2998 | 2924 | 2999 | 2924 | 3000 |
| 2925 | 2999 | 2925 | 3000 | 2925 | 3001 |
| 2926 | 3000 | 2926 | 3001 | 2926 | 2989 |
| 2927 | 3001 | 2927 | 2989 | 2927 | 2990 |

Fig. 9E

| TCRB V/J SET 7 | | TCRB V/J SET 8 | | TCRB V/J SET 9 | |
|---|---|---|---|---|---|
| SEQ ID NO:V | SEQ ID NO:J | SEQ ID NO:V | SEQ ID NO:J | SEQ ID NO:V | SEQ ID NO:J |
| 2928 | 2989 | 2928 | 2990 | 2928 | 2991 |
| 2929 | 2990 | 2929 | 2991 | 2929 | 2992 |
| 2930 | 2991 | 2930 | 2992 | 2930 | 2993 |
| 2931 | 2992 | 2931 | 2993 | 2931 | 2994 |
| 2932 | 2993 | 2932 | 2994 | 2932 | 2995 |
| 2933 | 2994 | 2933 | 2995 | 2933 | 2996 |
| 2934 | 2995 | 2934 | 2996 | 2934 | 2997 |
| 2935 | 2996 | 2935 | 2997 | 2935 | 2998 |
| 2936 | 2997 | 2936 | 2998 | 2936 | 2999 |
| 2937 | 2998 | 2937 | 2999 | 2937 | 3000 |
| 2938 | 2999 | 2938 | 3000 | 2938 | 3001 |
| 2939 | 3000 | 2939 | 3001 | 2939 | 2989 |
| 2940 | 3001 | 2940 | 2989 | 2940 | 2990 |
| 2941 | 2989 | 2941 | 2990 | 2941 | 2991 |
| 2942 | 2990 | 2942 | 2991 | 2942 | 2992 |
| 2943 | 2991 | 2943 | 2992 | 2943 | 2993 |
| 2944 | 2992 | 2944 | 2993 | 2944 | 2994 |
| 2945 | 2993 | 2945 | 2994 | 2945 | 2995 |
| 2946 | 2994 | 2946 | 2995 | 2946 | 2996 |
| 2947 | 2995 | 2947 | 2996 | 2947 | 2997 |
| 2948 | 2996 | 2948 | 2997 | 2948 | 2998 |
| 2949 | 2997 | 2949 | 2998 | 2949 | 2999 |
| 2950 | 2998 | 2950 | 2999 | 2950 | 3000 |
| 2951 | 2999 | 2951 | 3000 | 2951 | 3001 |
| 2952 | 3000 | 2952 | 3001 | 2952 | 2989 |
| 2953 | 3001 | 2953 | 2989 | 2953 | 2990 |
| 2954 | 2989 | 2954 | 2990 | 2954 | 2991 |
| 2955 | 2990 | 2955 | 2991 | 2955 | 2992 |
| 2956 | 2991 | 2956 | 2992 | 2956 | 2993 |
| 2957 | 2992 | 2957 | 2993 | 2957 | 2994 |
| 2958 | 2993 | 2958 | 2994 | 2958 | 2995 |

Fig. 9F

| TCRB V/J SET 7 | | TCRB V/J SET 8 | | TCRB V/J SET 9 | |
|---|---|---|---|---|---|
| SEQ ID NO:V | SEQ ID NO:J | SEQ ID NO:V | SEQ ID NO:J | SEQ ID NO:V | SEQ ID NO:J |
| 2959 | 2994 | 2959 | 2995 | 2959 | 2996 |
| 2960 | 2995 | 2960 | 2996 | 2960 | 2997 |
| 2961 | 2996 | 2961 | 2997 | 2961 | 2998 |
| 2962 | 2997 | 2962 | 2998 | 2962 | 2999 |
| 2963 | 2998 | 2963 | 2999 | 2963 | 3000 |
| 2964 | 2999 | 2964 | 3000 | 2964 | 3001 |
| 2965 | 3000 | 2965 | 3001 | 2965 | 2989 |
| 2966 | 3001 | 2966 | 2989 | 2966 | 2990 |
| 2967 | 2989 | 2967 | 2990 | 2967 | 2991 |
| 2968 | 2990 | 2968 | 2991 | 2968 | 2992 |
| 2969 | 2991 | 2969 | 2992 | 2969 | 2993 |
| 2970 | 2992 | 2970 | 2993 | 2970 | 2994 |
| 2971 | 2993 | 2971 | 2994 | 2971 | 2995 |
| 2972 | 2994 | 2972 | 2995 | 2972 | 2996 |
| 2973 | 2995 | 2973 | 2996 | 2973 | 2997 |
| 2974 | 2996 | 2974 | 2997 | 2974 | 2998 |
| 2975 | 2997 | 2975 | 2998 | 2975 | 2999 |
| 2976 | 2998 | 2976 | 2999 | 2976 | 3000 |
| 2977 | 2999 | 2977 | 3000 | 2977 | 3001 |
| 2978 | 3000 | 2978 | 3001 | 2978 | 2989 |
| 2979 | 3001 | 2979 | 2989 | 2979 | 2990 |
| 2980 | 2989 | 2980 | 2990 | 2980 | 2991 |
| 2981 | 2990 | 2981 | 2991 | 2981 | 2992 |
| 2982 | 2991 | 2982 | 2992 | 2982 | 2993 |
| 2983 | 2992 | 2983 | 2993 | 2983 | 2994 |
| 2984 | 2993 | 2984 | 2994 | 2984 | 2995 |
| 2985 | 2994 | 2985 | 2995 | 2985 | 2996 |
| 2986 | 2995 | 2986 | 2996 | 2986 | 2997 |
| 2987 | 2996 | 2987 | 2997 | 2987 | 2998 |
| 2988 | 2997 | 2988 | 2998 | 2988 | 2999 |

Fig. 9G

| TCRB V/J SET 10 | | TCRB V/J SET 11 | | TCRB V/J SET 12 | |
|---|---|---|---|---|---|
| SEQ ID NO:V | SEQ ID NO:J | SEQ ID NO:V | SEQ ID NO:J | SEQ ID NO:V | SEQ ID NO:J |
| 2921 | 2998 | 2921 | 2999 | 2921 | 3000 |
| 2922 | 2999 | 2922 | 3000 | 2922 | 3001 |
| 2923 | 3000 | 2923 | 3001 | 2923 | 2989 |
| 2924 | 3001 | 2924 | 2989 | 2924 | 2990 |
| 2925 | 2989 | 2925 | 2990 | 2925 | 2991 |
| 2926 | 2990 | 2926 | 2991 | 2926 | 2992 |
| 2927 | 2991 | 2927 | 2992 | 2927 | 2993 |
| 2928 | 2992 | 2928 | 2993 | 2928 | 2994 |
| 2929 | 2993 | 2929 | 2994 | 2929 | 2995 |
| 2930 | 2994 | 2930 | 2995 | 2930 | 2996 |
| 2931 | 2995 | 2931 | 2996 | 2931 | 2997 |
| 2932 | 2996 | 2932 | 2997 | 2932 | 2998 |
| 2933 | 2997 | 2933 | 2998 | 2933 | 2999 |
| 2934 | 2998 | 2934 | 2999 | 2934 | 3000 |
| 2935 | 2999 | 2935 | 3000 | 2935 | 3001 |
| 2936 | 3000 | 2936 | 3001 | 2936 | 2989 |
| 2937 | 3001 | 2937 | 2989 | 2937 | 2990 |
| 2938 | 2989 | 2938 | 2990 | 2938 | 2991 |
| 2939 | 2990 | 2939 | 2991 | 2939 | 2992 |
| 2940 | 2991 | 2940 | 2992 | 2940 | 2993 |
| 2941 | 2992 | 2941 | 2993 | 2941 | 2994 |
| 2942 | 2993 | 2942 | 2994 | 2942 | 2995 |
| 2943 | 2994 | 2943 | 2995 | 2943 | 2996 |
| 2944 | 2995 | 2944 | 2996 | 2944 | 2997 |
| 2945 | 2996 | 2945 | 2997 | 2945 | 2998 |
| 2946 | 2997 | 2946 | 2998 | 2946 | 2999 |
| 2947 | 2998 | 2947 | 2999 | 2947 | 3000 |
| 2948 | 2999 | 2948 | 3000 | 2948 | 3001 |
| 2949 | 3000 | 2949 | 3001 | 2949 | 2989 |
| 2950 | 3001 | 2950 | 2989 | 2950 | 2990 |

Fig. 9H

| TCRB V/J SET 10 | | TCRB V/J SET 11 | | TCRB V/J SET 12 | |
|---|---|---|---|---|---|
| SEQ ID NO:V | SEQ ID NO:J | SEQ ID NO:V | SEQ ID NO:J | SEQ ID NO:V | SEQ ID NO:J |
| 2951 | 2989 | 2951 | 2990 | 2951 | 2991 |
| 2952 | 2990 | 2952 | 2991 | 2952 | 2992 |
| 2953 | 2991 | 2953 | 2992 | 2953 | 2993 |
| 2954 | 2992 | 2954 | 2993 | 2954 | 2994 |
| 2955 | 2993 | 2955 | 2994 | 2955 | 2995 |
| 2956 | 2994 | 2956 | 2995 | 2956 | 2996 |
| 2957 | 2995 | 2957 | 2996 | 2957 | 2997 |
| 2958 | 2996 | 2958 | 2997 | 2958 | 2998 |
| 2959 | 2997 | 2959 | 2998 | 2959 | 2999 |
| 2960 | 2998 | 2960 | 2999 | 2960 | 3000 |
| 2961 | 2999 | 2961 | 3000 | 2961 | 3001 |
| 2962 | 3000 | 2962 | 3001 | 2962 | 2989 |
| 2963 | 3001 | 2963 | 2989 | 2963 | 2990 |
| 2964 | 2989 | 2964 | 2990 | 2964 | 2991 |
| 2965 | 2990 | 2965 | 2991 | 2965 | 2992 |
| 2966 | 2991 | 2966 | 2992 | 2966 | 2993 |
| 2967 | 2992 | 2967 | 2993 | 2967 | 2994 |
| 2968 | 2993 | 2968 | 2994 | 2968 | 2995 |
| 2969 | 2994 | 2969 | 2995 | 2969 | 2996 |
| 2970 | 2995 | 2970 | 2996 | 2970 | 2997 |
| 2971 | 2996 | 2971 | 2997 | 2971 | 2998 |
| 2972 | 2997 | 2972 | 2998 | 2972 | 2999 |
| 2973 | 2998 | 2973 | 2999 | 2973 | 3000 |
| 2974 | 2999 | 2974 | 3000 | 2974 | 3001 |
| 2975 | 3000 | 2975 | 3001 | 2975 | 2989 |
| 2976 | 3001 | 2976 | 2989 | 2976 | 2990 |
| 2977 | 2989 | 2977 | 2990 | 2977 | 2991 |
| 2978 | 2990 | 2978 | 2991 | 2978 | 2992 |
| 2979 | 2991 | 2979 | 2992 | 2979 | 2993 |
| 2980 | 2992 | 2980 | 2993 | 2980 | 2994 |
| 2981 | 2993 | 2981 | 2994 | 2981 | 2995 |

Fig. 9I

| TCRB V/J SET 10 | |
|---|---|
| SEQ ID NO:V | SEQ ID NO:J |
| 2982 | 2994 |
| 2983 | 2995 |
| 2984 | 2996 |
| 2985 | 2997 |
| 2986 | 2998 |
| 2987 | 2999 |
| 2988 | 3000 |

| TCRB V/J SET 11 | |
|---|---|
| SEQ ID NO:V | SEQ ID NO:J |
| 2982 | 2995 |
| 2983 | 2996 |
| 2984 | 2997 |
| 2985 | 2998 |
| 2986 | 2999 |
| 2987 | 3000 |
| 2988 | 3001 |

| TCRB V/J SET 12 | |
|---|---|
| SEQ ID NO:V | SEQ ID NO:J |
| 2982 | 2996 |
| 2983 | 2997 |
| 2984 | 2998 |
| 2985 | 2999 |
| 2986 | 3000 |
| 2987 | 3001 |
| 2988 | 2989 |

| TCRB V/J SET 13 | |
|---|---|
| SEQ ID NO:V | SEQ ID NO:J |
| 2921 | 3001 |
| 2922 | 2989 |
| 2923 | 2990 |
| 2924 | 2991 |
| 2925 | 2992 |
| 2926 | 2993 |
| 2927 | 2994 |
| 2928 | 2995 |
| 2929 | 2996 |
| 2930 | 2997 |
| 2931 | 2998 |
| 2932 | 2999 |
| 2933 | 3000 |
| 2934 | 3001 |
| 2935 | 2989 |
| 2936 | 2990 |
| 2937 | 2991 |
| 2938 | 2992 |
| 2939 | 2993 |
| 2940 | 2994 |

Fig. 9J

| TCRB V/J SET 13 | |
|---|---|
| SEQ ID NO:V | SEQ ID NO:J |
| 2941 | 2995 |
| 2942 | 2996 |
| 2943 | 2997 |
| 2944 | 2998 |
| 2945 | 2999 |
| 2946 | 3000 |
| 2947 | 3001 |
| 2948 | 2989 |
| 2949 | 2990 |
| 2950 | 2991 |
| 2951 | 2992 |
| 2952 | 2993 |
| 2953 | 2994 |
| 2954 | 2995 |
| 2955 | 2996 |
| 2956 | 2997 |
| 2957 | 2998 |
| 2958 | 2999 |
| 2959 | 3000 |
| 2960 | 3001 |
| 2961 | 2989 |
| 2962 | 2990 |
| 2963 | 2991 |
| 2964 | 2992 |
| 2965 | 2993 |
| 2966 | 2994 |
| 2967 | 2995 |
| 2968 | 2996 |
| 2969 | 2997 |
| 2970 | 2998 |
| 2971 | 2999 |

Fig. 9K

| TCRB V/J SET 13 | |
|---|---|
| SEQ ID NO:V | SEQ ID NO:J |
| 2972 | 3000 |
| 2973 | 3001 |
| 2974 | 2989 |
| 2975 | 2990 |
| 2976 | 2991 |
| 2977 | 2992 |
| 2978 | 2993 |
| 2979 | 2994 |
| 2980 | 2995 |
| 2981 | 2996 |
| 2982 | 2997 |
| 2983 | 2998 |
| 2984 | 2999 |
| 2985 | 3000 |
| 2986 | 3001 |
| 2987 | 2989 |
| 2988 | 2990 |

Fig. 9L

| TCRG V/J SET 1 | | TCRG V/J SET 2 | | TCRG V/J SET 3 | |
|---|---|---|---|---|---|
| SEQ ID NO:V | SEQ ID NO:J | SEQ ID NO:V | SEQ ID NO:J | SEQ ID NO:V | SEQ ID NO:J |
| 3002 | 3016 | 3002 | 3017 | 3002 | 3018 |
| 3003 | 3017 | 3003 | 3018 | 3003 | 3019 |
| 3004 | 3018 | 3004 | 3019 | 3004 | 3020 |
| 3005 | 3019 | 3005 | 3020 | 3005 | 3016 |
| 3006 | 3020 | 3006 | 3016 | 3006 | 3017 |
| 3007 | 3016 | 3007 | 3017 | 3007 | 3018 |
| 3008 | 3017 | 3008 | 3018 | 3008 | 3019 |
| 3009 | 3018 | 3009 | 3019 | 3009 | 3020 |
| 3010 | 3019 | 3010 | 3020 | 3010 | 3016 |
| 3011 | 3020 | 3011 | 3016 | 3011 | 3017 |
| 3012 | 3016 | 3012 | 3017 | 3012 | 3018 |
| 3013 | 3017 | 3013 | 3018 | 3013 | 3019 |
| 3014 | 3018 | 3014 | 3019 | 3014 | 3020 |
| 3015 | 3019 | 3015 | 3020 | 3015 | 3016 |

| TCRG V/J SET 4 | | TCRG V/J SET 5 | |
|---|---|---|---|
| SEQ ID NO:V | SEQ ID NO:J | SEQ ID NO:V | SEQ ID NO:J |
| 3002 | 3019 | 3002 | 3020 |
| 3003 | 3020 | 3003 | 3016 |
| 3004 | 3016 | 3004 | 3017 |
| 3005 | 3017 | 3005 | 3018 |
| 3006 | 3018 | 3006 | 3019 |
| 3007 | 3019 | 3007 | 3020 |
| 3008 | 3020 | 3008 | 3016 |
| 3009 | 3016 | 3009 | 3017 |

Fig. 10A

| TCRG V/J SET 4 | | TCRG V/J SET 5 | |
|---|---|---|---|
| SEQ ID NO:V | SEQ ID NO:J | SEQ ID NO:V | SEQ ID NO:J |
| 3010 | 3017 | 3010 | 3018 |
| 3011 | 3018 | 3011 | 3019 |
| 3012 | 3019 | 3012 | 3020 |
| 3013 | 3020 | 3013 | 3016 |
| 3014 | 3016 | 3014 | 3017 |
| 3015 | 3017 | 3015 | 3018 |

Fig. 10B

| IGH V/J SET 1 | | IGH V/J SET 2 | | IGH V/J SET 3 | |
|---|---|---|---|---|---|
| SEQ ID NO: V | SEQ ID NO: J | SEQ ID NO: V | SEQ ID NO: J | SEQ ID NO: V | SEQ ID NO: J |
| 3021 | 3148 | 3021 | 3149 | 3021 | 3150 |
| 3022 | 3149 | 3022 | 3150 | 3022 | 3151 |
| 3023 | 3150 | 3023 | 3151 | 3023 | 3152 |
| 3024 | 3151 | 3024 | 3152 | 3024 | 3153 |
| 3025 | 3152 | 3025 | 3153 | 3025 | 3154 |
| 3026 | 3153 | 3026 | 3154 | 3026 | 3155 |
| 3027 | 3154 | 3027 | 3155 | 3027 | 3156 |
| 3028 | 3155 | 3028 | 3156 | 3028 | 3148 |
| 3029 | 3156 | 3029 | 3148 | 3029 | 3149 |
| 3030 | 3148 | 3030 | 3149 | 3030 | 3150 |
| 3031 | 3149 | 3031 | 3150 | 3031 | 3151 |
| 3032 | 3150 | 3032 | 3151 | 3032 | 3152 |
| 3033 | 3151 | 3033 | 3152 | 3033 | 3153 |
| 3034 | 3152 | 3034 | 3153 | 3034 | 3154 |
| 3035 | 3153 | 3035 | 3154 | 3035 | 3155 |
| 3036 | 3154 | 3036 | 3155 | 3036 | 3156 |
| 3037 | 3155 | 3037 | 3156 | 3037 | 3148 |
| 3038 | 3156 | 3038 | 3148 | 3038 | 3149 |
| 3039 | 3148 | 3039 | 3149 | 3039 | 3150 |
| 3040 | 3149 | 3040 | 3150 | 3040 | 3151 |
| 3041 | 3150 | 3041 | 3151 | 3041 | 3152 |
| 3042 | 3151 | 3042 | 3152 | 3042 | 3153 |
| 3043 | 3152 | 3043 | 3153 | 3043 | 3154 |
| 3044 | 3153 | 3044 | 3154 | 3044 | 3155 |
| 3045 | 3154 | 3045 | 3155 | 3045 | 3156 |
| 3046 | 3155 | 3046 | 3156 | 3046 | 3148 |
| 3047 | 3156 | 3047 | 3148 | 3047 | 3149 |

Fig. 11A

| IGH V/J SET 1 | | IGH V/J SET 2 | | IGH V/J SET 3 | |
|---|---|---|---|---|---|
| SEQ ID NO: V | SEQ ID NO:J | SEQ ID NO: V | SEQ ID NO:J | SEQ ID NO: V | SEQ ID NO:J |
| 3048 | 3148 | 3048 | 3149 | 3048 | 3150 |
| 3049 | 3149 | 3049 | 3150 | 3049 | 3151 |
| 3050 | 3150 | 3050 | 3151 | 3050 | 3152 |
| 3051 | 3151 | 3051 | 3152 | 3051 | 3153 |
| 3052 | 3152 | 3052 | 3153 | 3052 | 3154 |
| 3053 | 3153 | 3053 | 3154 | 3053 | 3155 |
| 3054 | 3154 | 3054 | 3155 | 3054 | 3156 |
| 3055 | 3155 | 3055 | 3156 | 3055 | 3148 |
| 3056 | 3156 | 3056 | 3148 | 3056 | 3149 |
| 3057 | 3148 | 3057 | 3149 | 3057 | 3150 |
| 3058 | 3149 | 3058 | 3150 | 3058 | 3151 |
| 3059 | 3150 | 3059 | 3151 | 3059 | 3152 |
| 3060 | 3151 | 3060 | 3152 | 3060 | 3153 |
| 3061 | 3152 | 3061 | 3153 | 3061 | 3154 |
| 3062 | 3153 | 3062 | 3154 | 3062 | 3155 |
| 3063 | 3154 | 3063 | 3155 | 3063 | 3156 |
| 3064 | 3155 | 3064 | 3156 | 3064 | 3148 |
| 3065 | 3156 | 3065 | 3148 | 3065 | 3149 |
| 3066 | 3148 | 3066 | 3149 | 3066 | 3150 |
| 3067 | 3149 | 3067 | 3150 | 3067 | 3151 |
| 3068 | 3150 | 3068 | 3151 | 3068 | 3152 |
| 3069 | 3151 | 3069 | 3152 | 3069 | 3153 |
| 3070 | 3152 | 3070 | 3153 | 3070 | 3154 |
| 3071 | 3153 | 3071 | 3154 | 3071 | 3155 |
| 3072 | 3154 | 3072 | 3155 | 3072 | 3156 |
| 3073 | 3155 | 3073 | 3156 | 3073 | 3148 |
| 3074 | 3156 | 3074 | 3148 | 3074 | 3149 |
| 3075 | 3148 | 3075 | 3149 | 3075 | 3150 |
| 3076 | 3149 | 3076 | 3150 | 3076 | 3151 |
| 3077 | 3150 | 3077 | 3151 | 3077 | 3152 |
| 3078 | 3151 | 3078 | 3152 | 3078 | 3153 |

Fig. 11B

| IGH V/J SET 1 | | IGH V/J SET 2 | | IGH V/J SET 3 | |
|---|---|---|---|---|---|
| SEQ ID NO: V | SEQ ID NO: J | SEQ ID NO: V | SEQ ID NO: J | SEQ ID NO: V | SEQ ID NO: J |
| 3079 | 3152 | 3079 | 3153 | 3079 | 3154 |
| 3080 | 3153 | 3080 | 3154 | 3080 | 3155 |
| 3081 | 3154 | 3081 | 3155 | 3081 | 3156 |
| 3082 | 3155 | 3082 | 3156 | 3082 | 3148 |
| 3083 | 3156 | 3083 | 3148 | 3083 | 3149 |
| 3084 | 3148 | 3084 | 3149 | 3084 | 3150 |
| 3085 | 3149 | 3085 | 3150 | 3085 | 3151 |
| 3086 | 3150 | 3086 | 3151 | 3086 | 3152 |
| 3087 | 3151 | 3087 | 3152 | 3087 | 3153 |
| 3088 | 3152 | 3088 | 3153 | 3088 | 3154 |
| 3089 | 3153 | 3089 | 3154 | 3089 | 3155 |
| 3090 | 3154 | 3090 | 3155 | 3090 | 3156 |
| 3091 | 3155 | 3091 | 3156 | 3091 | 3148 |
| 3092 | 3156 | 3092 | 3148 | 3092 | 3149 |
| 3093 | 3148 | 3093 | 3149 | 3093 | 3150 |
| 3094 | 3149 | 3094 | 3150 | 3094 | 3151 |
| 3095 | 3150 | 3095 | 3151 | 3095 | 3152 |
| 3096 | 3151 | 3096 | 3152 | 3096 | 3153 |
| 3097 | 3152 | 3097 | 3153 | 3097 | 3154 |
| 3098 | 3153 | 3098 | 3154 | 3098 | 3155 |
| 3099 | 3154 | 3099 | 3155 | 3099 | 3156 |
| 3100 | 3155 | 3100 | 3156 | 3100 | 3148 |
| 3101 | 3156 | 3101 | 3148 | 3101 | 3149 |
| 3102 | 3148 | 3102 | 3149 | 3102 | 3150 |
| 3103 | 3149 | 3103 | 3150 | 3103 | 3151 |
| 3104 | 3150 | 3104 | 3151 | 3104 | 3152 |
| 3105 | 3151 | 3105 | 3152 | 3105 | 3153 |
| 3106 | 3152 | 3106 | 3153 | 3106 | 3154 |
| 3107 | 3153 | 3107 | 3154 | 3107 | 3155 |
| 3108 | 3154 | 3108 | 3155 | 3108 | 3156 |
| 3109 | 3155 | 3109 | 3156 | 3109 | 3148 |

Fig. 11C

| IGH V/J SET 1 | | IGH V/J SET 2 | | IGH V/J SET 3 | |
|---|---|---|---|---|---|
| SEQ ID NO: V | SEQ ID NO:J | SEQ ID NO: V | SEQ ID NO:J | SEQ ID NO: V | SEQ ID NO:J |
| 3110 | 3156 | 3110 | 3148 | 3110 | 3149 |
| 3111 | 3148 | 3111 | 3149 | 3111 | 3150 |
| 3112 | 3149 | 3112 | 3150 | 3112 | 3151 |
| 3113 | 3150 | 3113 | 3151 | 3113 | 3152 |
| 3114 | 3151 | 3114 | 3152 | 3114 | 3153 |
| 3115 | 3152 | 3115 | 3153 | 3115 | 3154 |
| 3116 | 3153 | 3116 | 3154 | 3116 | 3155 |
| 3117 | 3154 | 3117 | 3155 | 3117 | 3156 |
| 3118 | 3155 | 3118 | 3156 | 3118 | 3148 |
| 3119 | 3156 | 3119 | 3148 | 3119 | 3149 |
| 3120 | 3148 | 3120 | 3149 | 3120 | 3150 |
| 3121 | 3149 | 3121 | 3150 | 3121 | 3151 |
| 3122 | 3150 | 3122 | 3151 | 3122 | 3152 |
| 3123 | 3151 | 3123 | 3152 | 3123 | 3153 |
| 3124 | 3152 | 3124 | 3153 | 3124 | 3154 |
| 3125 | 3153 | 3125 | 3154 | 3125 | 3155 |
| 3126 | 3154 | 3126 | 3155 | 3126 | 3156 |
| 3127 | 3155 | 3127 | 3156 | 3127 | 3148 |
| 3128 | 3156 | 3128 | 3148 | 3128 | 3149 |
| 3129 | 3148 | 3129 | 3149 | 3129 | 3150 |
| 3130 | 3149 | 3130 | 3150 | 3130 | 3151 |
| 3131 | 3150 | 3131 | 3151 | 3131 | 3152 |
| 3132 | 3151 | 3132 | 3152 | 3132 | 3153 |
| 3133 | 3152 | 3133 | 3153 | 3133 | 3154 |
| 3134 | 3153 | 3134 | 3154 | 3134 | 3155 |
| 3135 | 3154 | 3135 | 3155 | 3135 | 3156 |
| 3136 | 3155 | 3136 | 3156 | 3136 | 3148 |
| 3137 | 3156 | 3137 | 3148 | 3137 | 3149 |
| 3138 | 3148 | 3138 | 3149 | 3138 | 3150 |
| 3139 | 3149 | 3139 | 3150 | 3139 | 3151 |
| 3140 | 3150 | 3140 | 3151 | 3140 | 3152 |

Fig. 11D

| IGH V/J SET 1 | | IGH V/J SET 2 | | IGH V/J SET 3 | |
|---|---|---|---|---|---|
| SEQ ID NO: V | SEQ ID NO:J | SEQ ID NO: V | SEQ ID NO:J | SEQ ID NO: V | SEQ ID NO:J |
| 3141 | 3151 | 3141 | 3152 | 3141 | 3153 |
| 3142 | 3152 | 3142 | 3153 | 3142 | 3154 |
| 3143 | 3153 | 3143 | 3154 | 3143 | 3155 |
| 3144 | 3154 | 3144 | 3155 | 3144 | 3156 |
| 3145 | 3155 | 3145 | 3156 | 3145 | 3148 |
| 3146 | 3156 | 3146 | 3148 | 3146 | 3149 |
| 3147 | 3148 | 3147 | 3149 | 3147 | 3150 |

| IGH V/J SET 4 | | IGH V/J SET 5 | | IGH V/J SET 6 | |
|---|---|---|---|---|---|
| SEQ ID NO: V | SEQ ID NO:J | SEQ ID NO: V | SEQ ID NO:J | SEQ ID NO: V | SEQ ID NO:J |
| 3021 | 3151 | 3021 | 3152 | 3021 | 3153 |
| 3022 | 3152 | 3022 | 3153 | 3022 | 3154 |
| 3023 | 3153 | 3023 | 3154 | 3023 | 3155 |
| 3024 | 3154 | 3024 | 3155 | 3024 | 3156 |
| 3025 | 3155 | 3025 | 3156 | 3025 | 3148 |
| 3026 | 3156 | 3026 | 3148 | 3026 | 3149 |
| 3027 | 3148 | 3027 | 3149 | 3027 | 3150 |
| 3028 | 3149 | 3028 | 3150 | 3028 | 3151 |
| 3029 | 3150 | 3029 | 3151 | 3029 | 3152 |
| 3030 | 3151 | 3030 | 3152 | 3030 | 3153 |
| 3031 | 3152 | 3031 | 3153 | 3031 | 3154 |
| 3032 | 3153 | 3032 | 3154 | 3032 | 3155 |
| 3033 | 3154 | 3033 | 3155 | 3033 | 3156 |
| 3034 | 3155 | 3034 | 3156 | 3034 | 3148 |
| 3035 | 3156 | 3035 | 3148 | 3035 | 3149 |
| 3036 | 3148 | 3036 | 3149 | 3036 | 3150 |
| 3037 | 3149 | 3037 | 3150 | 3037 | 3151 |
| 3038 | 3150 | 3038 | 3151 | 3038 | 3152 |
| 3039 | 3151 | 3039 | 3152 | 3039 | 3153 |
| 3040 | 3152 | 3040 | 3153 | 3040 | 3154 |

Fig. 11E

| IGH V/J SET 4 | | IGH V/J SET 5 | | IGH V/J SET 6 | |
|---|---|---|---|---|---|
| SEQ ID NO: V | SEQ ID NO: J | SEQ ID NO: V | SEQ ID NO: J | SEQ ID NO: V | SEQ ID NO: J |
| 3041 | 3153 | 3041 | 3154 | 3041 | 3155 |
| 3042 | 3154 | 3042 | 3155 | 3042 | 3156 |
| 3043 | 3155 | 3043 | 3156 | 3043 | 3148 |
| 3044 | 3156 | 3044 | 3148 | 3044 | 3149 |
| 3045 | 3148 | 3045 | 3149 | 3045 | 3150 |
| 3046 | 3149 | 3046 | 3150 | 3046 | 3151 |
| 3047 | 3150 | 3047 | 3151 | 3047 | 3152 |
| 3048 | 3151 | 3048 | 3152 | 3048 | 3153 |
| 3049 | 3152 | 3049 | 3153 | 3049 | 3154 |
| 3050 | 3153 | 3050 | 3154 | 3050 | 3155 |
| 3051 | 3154 | 3051 | 3155 | 3051 | 3156 |
| 3052 | 3155 | 3052 | 3156 | 3052 | 3148 |
| 3053 | 3156 | 3053 | 3148 | 3053 | 3149 |
| 3054 | 3148 | 3054 | 3149 | 3054 | 3150 |
| 3055 | 3149 | 3055 | 3150 | 3055 | 3151 |
| 3056 | 3150 | 3056 | 3151 | 3056 | 3152 |
| 3057 | 3151 | 3057 | 3152 | 3057 | 3153 |
| 3058 | 3152 | 3058 | 3153 | 3058 | 3154 |
| 3059 | 3153 | 3059 | 3154 | 3059 | 3155 |
| 3060 | 3154 | 3060 | 3155 | 3060 | 3156 |
| 3061 | 3155 | 3061 | 3156 | 3061 | 3148 |
| 3062 | 3156 | 3062 | 3148 | 3062 | 3149 |
| 3063 | 3148 | 3063 | 3149 | 3063 | 3150 |
| 3064 | 3149 | 3064 | 3150 | 3064 | 3151 |
| 3065 | 3150 | 3065 | 3151 | 3065 | 3152 |
| 3066 | 3151 | 3066 | 3152 | 3066 | 3153 |
| 3067 | 3152 | 3067 | 3153 | 3067 | 3154 |
| 3068 | 3153 | 3068 | 3154 | 3068 | 3155 |
| 3069 | 3154 | 3069 | 3155 | 3069 | 3156 |
| 3070 | 3155 | 3070 | 3156 | 3070 | 3148 |
| 3071 | 3156 | 3071 | 3148 | 3071 | 3149 |

Fig. 11F

| IGH V/J SET 4 | | IGH V/J SET 5 | | IGH V/J SET 6 | |
|---|---|---|---|---|---|
| SEQ ID NO: V | SEQ ID NO:J | SEQ ID NO: V | SEQ ID NO:J | SEQ ID NO: V | SEQ ID NO:J |
| 3072 | 3148 | 3072 | 3149 | 3072 | 3150 |
| 3073 | 3149 | 3073 | 3150 | 3073 | 3151 |
| 3074 | 3150 | 3074 | 3151 | 3074 | 3152 |
| 3075 | 3151 | 3075 | 3152 | 3075 | 3153 |
| 3076 | 3152 | 3076 | 3153 | 3076 | 3154 |
| 3077 | 3153 | 3077 | 3154 | 3077 | 3155 |
| 3078 | 3154 | 3078 | 3155 | 3078 | 3156 |
| 3079 | 3155 | 3079 | 3156 | 3079 | 3148 |
| 3080 | 3156 | 3080 | 3148 | 3080 | 3149 |
| 3081 | 3148 | 3081 | 3149 | 3081 | 3150 |
| 3082 | 3149 | 3082 | 3150 | 3082 | 3151 |
| 3083 | 3150 | 3083 | 3151 | 3083 | 3152 |
| 3084 | 3151 | 3084 | 3152 | 3084 | 3153 |
| 3085 | 3152 | 3085 | 3153 | 3085 | 3154 |
| 3086 | 3153 | 3086 | 3154 | 3086 | 3155 |
| 3087 | 3154 | 3087 | 3155 | 3087 | 3156 |
| 3088 | 3155 | 3088 | 3156 | 3088 | 3148 |
| 3089 | 3156 | 3089 | 3148 | 3089 | 3149 |
| 3090 | 3148 | 3090 | 3149 | 3090 | 3150 |
| 3091 | 3149 | 3091 | 3150 | 3091 | 3151 |
| 3092 | 3150 | 3092 | 3151 | 3092 | 3152 |
| 3093 | 3151 | 3093 | 3152 | 3093 | 3153 |
| 3094 | 3152 | 3094 | 3153 | 3094 | 3154 |
| 3095 | 3153 | 3095 | 3154 | 3095 | 3155 |
| 3096 | 3154 | 3096 | 3155 | 3096 | 3156 |
| 3097 | 3155 | 3097 | 3156 | 3097 | 3148 |
| 3098 | 3156 | 3098 | 3148 | 3098 | 3149 |
| 3099 | 3148 | 3099 | 3149 | 3099 | 3150 |
| 3100 | 3149 | 3100 | 3150 | 3100 | 3151 |
| 3101 | 3150 | 3101 | 3151 | 3101 | 3152 |
| 3102 | 3151 | 3102 | 3152 | 3102 | 3153 |

Fig. 11G

| IGH V/J SET 4 | | IGH V/J SET 5 | | IGH V/J SET 6 | |
|---|---|---|---|---|---|
| SEQ ID NO: V | SEQ ID NO: J | SEQ ID NO: V | SEQ ID NO: J | SEQ ID NO: V | SEQ ID NO: J |
| 3103 | 3152 | 3103 | 3153 | 3103 | 3154 |
| 3104 | 3153 | 3104 | 3154 | 3104 | 3155 |
| 3105 | 3154 | 3105 | 3155 | 3105 | 3156 |
| 3106 | 3155 | 3106 | 3156 | 3106 | 3148 |
| 3107 | 3156 | 3107 | 3148 | 3107 | 3149 |
| 3108 | 3148 | 3108 | 3149 | 3108 | 3150 |
| 3109 | 3149 | 3109 | 3150 | 3109 | 3151 |
| 3110 | 3150 | 3110 | 3151 | 3110 | 3152 |
| 3111 | 3151 | 3111 | 3152 | 3111 | 3153 |
| 3112 | 3152 | 3112 | 3153 | 3112 | 3154 |
| 3113 | 3153 | 3113 | 3154 | 3113 | 3155 |
| 3114 | 3154 | 3114 | 3155 | 3114 | 3156 |
| 3115 | 3155 | 3115 | 3156 | 3115 | 3148 |
| 3116 | 3156 | 3116 | 3148 | 3116 | 3149 |
| 3117 | 3148 | 3117 | 3149 | 3117 | 3150 |
| 3118 | 3149 | 3118 | 3150 | 3118 | 3151 |
| 3119 | 3150 | 3119 | 3151 | 3119 | 3152 |
| 3120 | 3151 | 3120 | 3152 | 3120 | 3153 |
| 3121 | 3152 | 3121 | 3153 | 3121 | 3154 |
| 3122 | 3153 | 3122 | 3154 | 3122 | 3155 |
| 3123 | 3154 | 3123 | 3155 | 3123 | 3156 |
| 3124 | 3155 | 3124 | 3156 | 3124 | 3148 |
| 3125 | 3156 | 3125 | 3148 | 3125 | 3149 |
| 3126 | 3148 | 3126 | 3149 | 3126 | 3150 |
| 3127 | 3149 | 3127 | 3150 | 3127 | 3151 |
| 3128 | 3150 | 3128 | 3151 | 3128 | 3152 |
| 3129 | 3151 | 3129 | 3152 | 3129 | 3153 |
| 3130 | 3152 | 3130 | 3153 | 3130 | 3154 |
| 3131 | 3153 | 3131 | 3154 | 3131 | 3155 |
| 3132 | 3154 | 3132 | 3155 | 3132 | 3156 |
| 3133 | 3155 | 3133 | 3156 | 3133 | 3148 |

Fig. 11H

| IGH V/J SET 4 | | IGH V/J SET 5 | | IGH V/J SET 6 | |
|---|---|---|---|---|---|
| SEQ ID NO: V | SEQ ID NO: J | SEQ ID NO: V | SEQ ID NO: J | SEQ ID NO: V | SEQ ID NO: J |
| 3134 | 3156 | 3134 | 3148 | 3134 | 3149 |
| 3135 | 3148 | 3135 | 3149 | 3135 | 3150 |
| 3136 | 3149 | 3136 | 3150 | 3136 | 3151 |
| 3137 | 3150 | 3137 | 3151 | 3137 | 3152 |
| 3138 | 3151 | 3138 | 3152 | 3138 | 3153 |
| 3139 | 3152 | 3139 | 3153 | 3139 | 3154 |
| 3140 | 3153 | 3140 | 3154 | 3140 | 3155 |
| 3141 | 3154 | 3141 | 3155 | 3141 | 3156 |
| 3142 | 3155 | 3142 | 3156 | 3142 | 3148 |
| 3143 | 3156 | 3143 | 3148 | 3143 | 3149 |
| 3144 | 3148 | 3144 | 3149 | 3144 | 3150 |
| 3145 | 3149 | 3145 | 3150 | 3145 | 3151 |
| 3146 | 3150 | 3146 | 3151 | 3146 | 3152 |
| 3147 | 3151 | 3147 | 3152 | 3147 | 3153 |

| IGH V/J SET 7 | | IGH V/J SET 8 | | IGH V/J SET 9 | |
|---|---|---|---|---|---|
| SEQ ID NO: V | SEQ ID NO: J | SEQ ID NO: V | SEQ ID NO: J | SEQ ID NO: V | SEQ ID NO: J |
| 3021 | 3154 | 3021 | 3155 | 3021 | 3156 |
| 3022 | 3155 | 3022 | 3156 | 3022 | 3148 |
| 3023 | 3156 | 3023 | 3148 | 3023 | 3149 |
| 3024 | 3148 | 3024 | 3149 | 3024 | 3150 |
| 3025 | 3149 | 3025 | 3150 | 3025 | 3151 |
| 3026 | 3150 | 3026 | 3151 | 3026 | 3152 |
| 3027 | 3151 | 3027 | 3152 | 3027 | 3153 |
| 3028 | 3152 | 3028 | 3153 | 3028 | 3154 |
| 3029 | 3153 | 3029 | 3154 | 3029 | 3155 |
| 3030 | 3154 | 3030 | 3155 | 3030 | 3156 |
| 3031 | 3155 | 3031 | 3156 | 3031 | 3148 |
| 3032 | 3156 | 3032 | 3148 | 3032 | 3149 |
| 3033 | 3148 | 3033 | 3149 | 3033 | 3150 |

Fig. 11I

| IGH V/J SET 7 | | IGH V/J SET 8 | | IGH V/J SET 9 | |
|---|---|---|---|---|---|
| SEQ ID NO: V | SEQ ID NO: J | SEQ ID NO: V | SEQ ID NO: J | SEQ ID NO: V | SEQ ID NO: J |
| 3034 | 3149 | 3034 | 3150 | 3034 | 3151 |
| 3035 | 3150 | 3035 | 3151 | 3035 | 3152 |
| 3036 | 3151 | 3036 | 3152 | 3036 | 3153 |
| 3037 | 3152 | 3037 | 3153 | 3037 | 3154 |
| 3038 | 3153 | 3038 | 3154 | 3038 | 3155 |
| 3039 | 3154 | 3039 | 3155 | 3039 | 3156 |
| 3040 | 3155 | 3040 | 3156 | 3040 | 3148 |
| 3041 | 3156 | 3041 | 3148 | 3041 | 3149 |
| 3042 | 3148 | 3042 | 3149 | 3042 | 3150 |
| 3043 | 3149 | 3043 | 3150 | 3043 | 3151 |
| 3044 | 3150 | 3044 | 3151 | 3044 | 3152 |
| 3045 | 3151 | 3045 | 3152 | 3045 | 3153 |
| 3046 | 3152 | 3046 | 3153 | 3046 | 3154 |
| 3047 | 3153 | 3047 | 3154 | 3047 | 3155 |
| 3048 | 3154 | 3048 | 3155 | 3048 | 3156 |
| 3049 | 3155 | 3049 | 3156 | 3049 | 3148 |
| 3050 | 3156 | 3050 | 3148 | 3050 | 3149 |
| 3051 | 3148 | 3051 | 3149 | 3051 | 3150 |
| 3052 | 3149 | 3052 | 3150 | 3052 | 3151 |
| 3053 | 3150 | 3053 | 3151 | 3053 | 3152 |
| 3054 | 3151 | 3054 | 3152 | 3054 | 3153 |
| 3055 | 3152 | 3055 | 3153 | 3055 | 3154 |
| 3056 | 3153 | 3056 | 3154 | 3056 | 3155 |
| 3057 | 3154 | 3057 | 3155 | 3057 | 3156 |
| 3058 | 3155 | 3058 | 3156 | 3058 | 3148 |
| 3059 | 3156 | 3059 | 3148 | 3059 | 3149 |
| 3060 | 3148 | 3060 | 3149 | 3060 | 3150 |
| 3061 | 3149 | 3061 | 3150 | 3061 | 3151 |
| 3062 | 3150 | 3062 | 3151 | 3062 | 3152 |
| 3063 | 3151 | 3063 | 3152 | 3063 | 3153 |
| 3064 | 3152 | 3064 | 3153 | 3064 | 3154 |

Fig. 11J

| IGH V/J SET 7 | | IGH V/J SET 8 | | IGH V/J SET 9 | |
| --- | --- | --- | --- | --- | --- |
| SEQ ID NO: V | SEQ ID NO: J | SEQ ID NO: V | SEQ ID NO: J | SEQ ID NO: V | SEQ ID NO: J |
| 3065 | 3153 | 3065 | 3154 | 3065 | 3155 |
| 3066 | 3154 | 3066 | 3155 | 3066 | 3156 |
| 3067 | 3155 | 3067 | 3156 | 3067 | 3148 |
| 3068 | 3156 | 3068 | 3148 | 3068 | 3149 |
| 3069 | 3148 | 3069 | 3149 | 3069 | 3150 |
| 3070 | 3149 | 3070 | 3150 | 3070 | 3151 |
| 3071 | 3150 | 3071 | 3151 | 3071 | 3152 |
| 3072 | 3151 | 3072 | 3152 | 3072 | 3153 |
| 3073 | 3152 | 3073 | 3153 | 3073 | 3154 |
| 3074 | 3153 | 3074 | 3154 | 3074 | 3155 |
| 3075 | 3154 | 3075 | 3155 | 3075 | 3156 |
| 3076 | 3155 | 3076 | 3156 | 3076 | 3148 |
| 3077 | 3156 | 3077 | 3148 | 3077 | 3149 |
| 3078 | 3148 | 3078 | 3149 | 3078 | 3150 |
| 3079 | 3149 | 3079 | 3150 | 3079 | 3151 |
| 3080 | 3150 | 3080 | 3151 | 3080 | 3152 |
| 3081 | 3151 | 3081 | 3152 | 3081 | 3153 |
| 3082 | 3152 | 3082 | 3153 | 3082 | 3154 |
| 3083 | 3153 | 3083 | 3154 | 3083 | 3155 |
| 3084 | 3154 | 3084 | 3155 | 3084 | 3156 |
| 3085 | 3155 | 3085 | 3156 | 3085 | 3148 |
| 3086 | 3156 | 3086 | 3148 | 3086 | 3149 |
| 3087 | 3148 | 3087 | 3149 | 3087 | 3150 |
| 3088 | 3149 | 3088 | 3150 | 3088 | 3151 |
| 3089 | 3150 | 3089 | 3151 | 3089 | 3152 |
| 3090 | 3151 | 3090 | 3152 | 3090 | 3153 |
| 3091 | 3152 | 3091 | 3153 | 3091 | 3154 |
| 3092 | 3153 | 3092 | 3154 | 3092 | 3155 |
| 3093 | 3154 | 3093 | 3155 | 3093 | 3156 |
| 3094 | 3155 | 3094 | 3156 | 3094 | 3148 |
| 3095 | 3156 | 3095 | 3148 | 3095 | 3149 |

Fig. 11K

| IGH V/J SET 7 | | IGH V/J SET 8 | | IGH V/J SET 9 | |
|---|---|---|---|---|---|
| SEQ ID NO: V | SEQ ID NO:J | SEQ ID NO: V | SEQ ID NO:J | SEQ ID NO: V | SEQ ID NO:J |
| 3096 | 3148 | 3096 | 3149 | 3096 | 3150 |
| 3097 | 3149 | 3097 | 3150 | 3097 | 3151 |
| 3098 | 3150 | 3098 | 3151 | 3098 | 3152 |
| 3099 | 3151 | 3099 | 3152 | 3099 | 3153 |
| 3100 | 3152 | 3100 | 3153 | 3100 | 3154 |
| 3101 | 3153 | 3101 | 3154 | 3101 | 3155 |
| 3102 | 3154 | 3102 | 3155 | 3102 | 3156 |
| 3103 | 3155 | 3103 | 3156 | 3103 | 3148 |
| 3104 | 3156 | 3104 | 3148 | 3104 | 3149 |
| 3105 | 3148 | 3105 | 3149 | 3105 | 3150 |
| 3106 | 3149 | 3106 | 3150 | 3106 | 3151 |
| 3107 | 3150 | 3107 | 3151 | 3107 | 3152 |
| 3108 | 3151 | 3108 | 3152 | 3108 | 3153 |
| 3109 | 3152 | 3109 | 3153 | 3109 | 3154 |
| 3110 | 3153 | 3110 | 3154 | 3110 | 3155 |
| 3111 | 3154 | 3111 | 3155 | 3111 | 3156 |
| 3112 | 3155 | 3112 | 3156 | 3112 | 3148 |
| 3113 | 3156 | 3113 | 3148 | 3113 | 3149 |
| 3114 | 3148 | 3114 | 3149 | 3114 | 3150 |
| 3115 | 3149 | 3115 | 3150 | 3115 | 3151 |
| 3116 | 3150 | 3116 | 3151 | 3116 | 3152 |
| 3117 | 3151 | 3117 | 3152 | 3117 | 3153 |
| 3118 | 3152 | 3118 | 3153 | 3118 | 3154 |
| 3119 | 3153 | 3119 | 3154 | 3119 | 3155 |
| 3120 | 3154 | 3120 | 3155 | 3120 | 3156 |
| 3121 | 3155 | 3121 | 3156 | 3121 | 3148 |
| 3122 | 3156 | 3122 | 3148 | 3122 | 3149 |
| 3123 | 3148 | 3123 | 3149 | 3123 | 3150 |
| 3124 | 3149 | 3124 | 3150 | 3124 | 3151 |
| 3125 | 3150 | 3125 | 3151 | 3125 | 3152 |
| 3126 | 3151 | 3126 | 3152 | 3126 | 3153 |

Fig. 11L

| IGH V/J SET 7 | | IGH V/J SET 8 | | IGH V/J SET 9 | |
|---|---|---|---|---|---|
| SEQ ID NO: V | SEQ ID NO: J | SEQ ID NO: V | SEQ ID NO: J | SEQ ID NO: V | SEQ ID NO: J |
| 3127 | 3152 | 3127 | 3153 | 3127 | 3154 |
| 3128 | 3153 | 3128 | 3154 | 3128 | 3155 |
| 3129 | 3154 | 3129 | 3155 | 3129 | 3156 |
| 3130 | 3155 | 3130 | 3156 | 3130 | 3148 |
| 3131 | 3156 | 3131 | 3148 | 3131 | 3149 |
| 3132 | 3148 | 3132 | 3149 | 3132 | 3150 |
| 3133 | 3149 | 3133 | 3150 | 3133 | 3151 |
| 3134 | 3150 | 3134 | 3151 | 3134 | 3152 |
| 3135 | 3151 | 3135 | 3152 | 3135 | 3153 |
| 3136 | 3152 | 3136 | 3153 | 3136 | 3154 |
| 3137 | 3153 | 3137 | 3154 | 3137 | 3155 |
| 3138 | 3154 | 3138 | 3155 | 3138 | 3156 |
| 3139 | 3155 | 3139 | 3156 | 3139 | 3148 |
| 3140 | 3156 | 3140 | 3148 | 3140 | 3149 |
| 3141 | 3148 | 3141 | 3149 | 3141 | 3150 |
| 3142 | 3149 | 3142 | 3150 | 3142 | 3151 |
| 3143 | 3150 | 3143 | 3151 | 3143 | 3152 |
| 3144 | 3151 | 3144 | 3152 | 3144 | 3153 |
| 3145 | 3152 | 3145 | 3153 | 3145 | 3154 |
| 3146 | 3153 | 3146 | 3154 | 3146 | 3155 |
| 3147 | 3154 | 3147 | 3155 | 3147 | 3156 |

Fig. 11M

DIAGNOSIS OF LYMPHOID MALIGNANCIES AND MINIMAL RESIDUAL DISEASE DETECTION

CROSS REFERENCE TO RELATED APPLICATION

This application claims the benefit under 35 U.S.C. 119(e) of U.S. Provisional Patent Application Nos. 61/569,118 filed Dec. 9, 2011; 61/644,294, filed May 8, 2012; and 61/726,489, filed Nov. 14, 2012, each of which prior applications is incorporated herein by reference in its entirety.

SEQUENCE LISTING

The instant application contains a Sequence Listing which has been submitted via EFS-Web and is hereby incorporated by reference in its entirety. Said ASCII copy, created on Mar. 28, 2013, is named 22448US_CRF_sequencelisting.txt, and is 4,203,178 bytes in size.

BACKGROUND

Technical Field

The present disclosure relates generally to the highly sensitive quantification of the relative representation of adaptive immune cells having a particular T cell receptor (TCR) or immunoglobulin (Ig) encoding gene rearrangement (e.g., clonotype), in samples obtained from a subject prior to and/or following therapeutic treatment. Determination of the relative frequencies of such clonotypes can be used to diagnose certain lymphoid hematologic malignancies and other disorders. Also, determination of the relative frequencies of such clonotypes following therapeutic treatment provides exquisitely sensitive detection of minimal residual disease (MRD).

Description of the Related Art

The adaptive immune system protects higher organisms against infections and other pathological events that may be attributable to foreign substances, using adaptive immune receptors, the antigen-specific recognition proteins that are expressed by hematopoietic cells of the lymphoid lineage and that are capable of distinguishing self from non-self molecules in the host. These lymphocytes may be found in the circulation and tissues of a host, and their recirculation between blood and the lymphatics has been described, including their extravasation via lymph node high endothelial venules, as well as at sites of infection, inflammation, tissue injury and other clinical insults. (See, e.g., Stein et al., 2005 *Immunol.* 116:1-12; DeNucci et al., 2009 *Crit. Rev. Immunol.* 29:87-109; Marelli-Berg et al., 2010 *Immunol.* 130:158; Ward et al., 2009 *Biochem. J.* 418:13; Gonzalez et al., 2011 *Ann. Rev. Immunol.* 29:215; Kehrl et al., 2009 *Curr. Top. Microb. Immunol.* 334:107; Steinmetz et al., 2009 *Front. Biosci.* (Schol. Ed.) 1:13.)

Accordingly, the dynamic nature of movement by lymphocytes throughout a host organism is reflected in changes in the qualitative (e.g., antigen-specificity of the clonally expressed adaptive immune receptor (immunoglobulin or T cell receptor), T cell versus B cell, T helper ($T_h$) cell versus T regulatory ($T_{reg}$) cell, effector T cell versus memory T cell, etc.) and quantitative distribution of lymphocytes among tissues, as a function of changes in host immune status.

The adaptive immune system employs several strategies to generate a repertoire of T- and B-cell antigen receptors with sufficient diversity to recognize the universe of potential pathogens. B lymphocytes mature to express antibodies (immunoglobulins, Igs or Igs, also referred to as B cell receptors, BCR) that occur as heterodimers of a heavy (H) a light (L) chain polypeptide, while T lymphocytes express heterodimeric T cell receptors (TCR). The ability of T cells to recognize the universe of antigens associated with various cancers or infectious organisms is conferred by its T cell antigen receptor (TCR), which is a heterodimer comprising an α (alpha) chain and a β (beta) chain, or a γ (gamma) and a δ (delta) chain. The proteins which make up these chains are encoded by DNA, which employs a unique mechanism for generating the tremendous diversity of the TCR. This multi-subunit immune recognition receptor associates with the CD3 complex and binds to peptides presented by the major histocompatibility complex (MHC) class I and II proteins on the surface of antigen-presenting cells (APCs). Binding of TCR to the antigenic peptide on the APC is a central event in T cell activation, which occurs at an immunological synapse at the point of contact between the T cell and the APC.

Each TCR peptide contains variable complementarity determining regions (CDRs), as well as framework regions (FRs) and a constant region. The sequence diversity of αβ T cells is largely determined by the amino acid sequence of the third complementarity-determining region (CDR3) loops of the α and β chain variable domains, which diversity is a result of recombination between variable ($V_\beta$), diversity ($D_\beta$), and joining ($J_\beta$) gene segments in the β chain locus, and between analogous $V_\alpha$ and $J_\alpha$ gene segments in the α chain locus, respectively. The existence of multiple such gene segments in the TCR α and β chain loci allows for a large number of distinct CDR3 sequences to be encoded. CDR3 sequence diversity is further increased by independent addition and deletion of nucleotides at the $V_\beta$-$D_\beta$, $D_\beta$-$J_\beta$, and $V_\alpha$-$J_\alpha$ junctions during the process of TCR gene rearrangement. In this respect, immunocompetence is reflected in the diversity of TCRs.

The γδ TCR is distinctive from the αβ TCR in that it encodes a receptor that interacts closely with the innate immune system. TCRγδ, is expressed early in development, has specialized anatomical distribution, has unique pathogen and small-molecule specificities, and has a broad spectrum of innate and adaptive cellular interactions. A biased pattern of TCRγ V and J segment expression is established early in ontogeny as the restricted subsets of TCRγδ cells populate the mouth, skin, gut, vagina, and lungs prenatally. Consequently, the diverse TCRγ repertoire in adult tissues is the result of extensive peripheral expansion following stimulation by environmental exposure to pathogens and toxic molecules.

Igs (BCR) expressed by B cells are proteins consisting of four polypeptide chains, two heavy chains (H chains) and two light chains (L chains), forming an $H_2L_2$ structure. Each pair of H and L chains contains a hypervariable domain, consisting of a $V_L$ and a $V_H$ region, and a constant domain. The H chains of Igs are of several types, μ, δ, γ, α, and β. The diversity of Igs within an individual is mainly determined by the hypervariable domain. Similar to the TCR, the V domain of Ig H chains is created by the combinatorial joining of the $V_H$, $D_H$, and $J_H$ gene segments. Hypervariable domain sequence diversity is further increased by independent addition and deletion of nucleotides at the $V_H$-$D_H$, $D_H$-$J_H$, and $V_H$-$J_H$ junctions during the process of Ig gene rearrangement. In this respect, immunocompetence is reflected in the diversity of Igs.

Quantitative characterization of adaptive immune cells based on the presence in such cells of functionally rearranged Ig and TCR encoding genes that direct productive expression of adaptive immune receptors has been achieved using biological samples from which adaptive immune cells can be readily isolated in significant numbers, such as blood, lymph or other biological fluids. In these samples, adaptive immune cells occur as particles in fluid suspension. See, e.g., US 2010/0330571; see also, e.g., Murphy, *Janeway's Immunobiology* (8$^{th}$ Ed.), 2011 Garland Science, NY, Appendix I, pp. 717-762.

Acute T-cell lymphoblastic leukemia/lymphoma (T-ALL) is an aggressive, immature, malignant T-cell neoplasm that affects both adult and pediatric patients. While there has been significant progress in treating these patients with improvements in achieving durable responses, it remains clear that a subset of these patients are inadequately treated and frequently present with disease relapse, while others may be over-treated due to an inability to sufficiently individualize clinical treatment. Several studies have confirmed the importance of assessing the potential presence of minimal residual disease (MRD) following a treatment regimen, to aid in predicting clinical outcomes of patients (1-3). For example, patients who demonstrate an early response to therapy, and who fail to exhibit sustained achievement of MRD, fare significantly better than those who do not (3).

Similarly, acute B-cell lymphoblastic leukemia/lymphoma (B-ALL) is an aggressive immature malignant B-cell neoplasm that affects adult and pediatric patients. While significant progress has been made to increase the number of patients who achieve durable long-term remission, a subset of patients relapses. As in T-ALL, multiple studies have confirmed that the presence and frequency of minimal residual disease are both important prognostic markers in B-ALL. In addition, several of these studies also support the use of these data to inform and individualize therapy (e.g., Yamaji et al., 2010 *Pediatr. Blood Canc.* 55(7):1287-95; Bhojwani et al., 2009 *Clin. Lymphoma Myeloma* 9 (Suppl. 3):S222-30.

Current clinical strategies for assessment of minimal residual disease include multi-parameteric flow cytometry (mpFC) and quantitative PCR-based methods using patient-specific primers (4, 5). mpFC typically permits detection of cells potentially responsible for recurrent/persistent disease with a sensitivity of on the order of $10^{-4}$ to $10^{-6}$ nucleated cells. However, interpretation of these data is operator- and laboratory-dependent, and consequently limited by poor standardization. Furthermore, variable expression of leukemic antigens in the post-therapy setting confounds MRD detection by mpFC (6).

By comparison, molecular-based methods for detection of minimal residual disease can achieve relatively increased sensitivity, on the order of $10^{-5}$ to $10^{-6}$ cells (7, 8). However, the previous configurations of these molecular assays, principally real-time quantitative PCR-based (RT-qPCR) assays using patient-specific primers that target adaptive immune receptor (e.g., T-cell receptor (TCR) or immunoglobulin (Ig)) variable region junctional sequences, or patient-specific translocations, are complex and challenging to implement in a uniform matter (7). For instance, these approaches require the production and use of individualized, patient-specific oligonucleotide probes for each patient, which is laborious, costly and time-consuming, and incompatible with the timeframe in which clinical decisions must be made.

High-throughput sequencing (HTS) is an emerging technology that can provide insight into the complexity of the adaptive immune response through the analysis of lymphoid receptor gene rearrangement (9). Studies using this technology have challenged understanding in the art of the extent of lymphocyte diversity occurring within, and shared by, individuals (9, 10), and have provided mechanistic insight into the early molecular genetic events critical for the T-cell lineage maturation (11). Recently, high-throughput sequencing of lymphoid cell adaptive immune receptor genes has been used to monitor lymphocyte diversity after adoptive immunotherapy with chimeric antigen receptor-modified T cells for the treatment of chemotherapy-refractory chronic lymphocytic leukemia (12). Separately, high-throughput sequencing of lymphoid cell adaptive immune receptor genes has been used for monitoring disease in B lymphoproliferative disorders (13). HTS has exhibited the ability to identify rare T cell clones (one T cell in 100,000) with high accuracy and reproducibility (14).

Clearly there is a need for improved sensitivity and specificity in the diagnosis of lymphoid hematological malignancies and other conditions that are reflected in the heterogeneity and relative frequencies of occurrence of particular unique adaptive immune receptors, and in the ability to detect minimal residual disease (MRD). The presently described embodiments address these needs and provide other related advantages.

BRIEF SUMMARY

According to certain embodiments of the invention described herein, there is provided a method for diagnosing a lymphoid hematological malignancy in a subject prior to therapy, and for detecting minimal residual disease for the lymphoid hematological malignancy in the subject after therapy, the method comprising: (I) for each of (i) one or a plurality of biological samples that each comprise a plurality of lymphoid hematopoietic cells and that are each obtained from the subject at one or more timepoints prior to therapy, and (ii) one or a plurality of biological samples that each comprise a plurality of lymphoidhematopoietic cells and that are each obtained from the subject at one or more timepoints after therapy, (a) amplifying DNA extracted from the biological sample in a multiplex polymerase chain reaction (PCR) that comprises: (i) a plurality of V-segment oligonucleotide primers that are each independently capable of specifically hybridizing to at least one polynucleotide encoding a human T cell receptor (TCR) V-region polypeptide, wherein each V-segment primer comprises a nucleotide sequence of at least 15 contiguous nucleotides that is complementary to at least one functional TCR Vγ-encoding or TCR Vβ-encoding gene segment and wherein the plurality of V-segment primers specifically hybridize to substantially all functional TCR Vγ-encoding or TCR Vβ-encoding gene segments that are present in the sample, and (ii) a plurality of J-segment oligonucleotide primers that are each independently capable of specifically hybridizing to at least one polynucleotide encoding a human T cell receptor (TCR) J-region polypeptide, wherein each J-segment primer comprises a nucleotide sequence of at least 15 contiguous nucleotides that is complementary to at least one functional TCR Jγ-encoding or TCR Jβ-encoding gene segment and wherein the plurality of J-segment primers specifically hybridize to substantially all functional TCR Jγ-encoding or TCR Jβ-encoding gene segments that are present in the sample, wherein the V-segment and J-segment primers are capable of promoting amplification in said multiplex polymerase chain reaction (PCR) of substantially all rearranged TCRγ CDR3-encoding regions or substantially all TCRβ CDR3-encoding regions in the sample to produce a multiplicity of amplified rearranged DNA molecules from a population of T cells in the sample, said multiplicity of amplified rearranged DNA molecules being sufficient to quantify diversity of the TCRγ CDR3-encoding region or TCRγ CDR3-encoding region in the population of T cells, and wherein each amplified rearranged DNA molecule in the multiplicity of amplified rearranged DNA molecules is less than 600 nucleotides in length; and (b) sequencing said multiplicity of amplified rearranged DNA molecules to determine, for each unique rearranged DNA molecule in said multiplicity of amplified rearranged DNA molecules, (i) a rearranged DNA sequence and (ii) a relative frequency of occurrence of the rearranged DNA sequence; and (II) comparing (i) the relative frequency of occurrence for each unique rearranged DNA sequence from said one or a plurality of biological samples that are each obtained from the subject at one or more timepoints prior to therapy, to (ii) the relative frequency of occurrence for each unique rearranged DNA sequence from said one or a plurality of biological samples that are each obtained from the subject at one or more timepoints after therapy, wherein (A) presence, in a sample obtained from the subject prior to therapy, of at least one unique rearranged DNA sequence that has a relative frequency of at least 15% of rearranged TCRγ CDR3-encoding regions or rearranged TCRβ CDR3-encoding regions is diagnostic for a clonal lymphoid hematological malignancy in the subject prior to therapy, and wherein (B) presence, in a sample obtained from the subject after therapy, of said at least one unique rearranged DNA sequence that is diagnostic for the clonal lymphoid hematological malignancy at a relative frequency of at least one in $10^5$ TCR CDR3-encoding regions, indicates minimal residual disease for the lymphoid hematological malignancy.

In certain further embodiments each functional TCR or Ig V-encoding gene segment comprises a V gene recombination signal sequence (RSS) and each functional TCR or Ig J-encoding gene segment comprises a J gene RSS, and wherein each amplified rearranged DNA molecule comprises (i) at least 10, 20, 30 or 40 contiguous nucleotides of a sense strand of the TCR or Ig V-encoding gene segment, said at least 10, 20, 30 or 40 contiguous nucleotides being situated 5' to the V gene RSS and (ii) at least 10, 20 or 30 contiguous nucleotides of a sense strand of the TCR or Ig J-encoding gene segment, said at least 10, 20 or 30 contiguous nucleotides being situated 3' to the J gene RSS.

In certain embodiments the plurality of V-segment oligonucleotide primers and the plurality of J-segment oligonucleotide primers comprise at least one of (1) the sequences set forth in SEQ ID NOs:5579-5643, (2) the sequences set forth in SEQ ID NOs:5644-5792, (3) the sequences set forth in SEQ ID NOs:5793-5816, (4) the sequences set forth in SEQ ID NOs:5817-6123, (5) the sequences set forth in SEQ ID NOs:6124-6127 and 6212-6215, (6) the sequences set forth in SEQ ID NOs:6128-6211 and 6216-6221, (7) the sequences set forth in SEQ ID NOs:6222-6286, and (8) the sequences set forth in SEQ ID NOs:6222-6351. In certain embodiments either or both of: (i) the V-segment oligonucleotide primers comprise one or a plurality of oligonucleotides that exhibit at least 90% sequence identity to one or more of the nucleotide sequences set forth in SEQ ID NOS:5579-5630, 5644-5779, 5799-5816, 6124-6127, and 6222-6273, and (ii) the J-segment primers comprise one or a plurality of oligonucleotides that exhibit at least 90% sequence identity to one or more of the nucleotide sequences set forth in SEQ ID NOS:5631-5643, 5780-5798, 6212-6215, and 6274-6286.

In certain other embodiments there is provided a method for diagnosing a lymphoid hematological malignancy in a subject, comprising (I) for each of (i) one or a plurality of biological samples that are obtained from the subject and that each comprise a plurality of lymphoid hematopoietic cells, (a) amplifying DNA extracted from the biological sample in a multiplex polymerase chain reaction (PCR) that comprises: (i) a plurality of V-segment oligonucleotide primers that are each independently capable of specifically hybridizing to at least one polynucleotide encoding a human T cell receptor (TCR) V-region polypeptide, wherein each V-segment primer comprises a nucleotide sequence of at least 15 contiguous nucleotides that is complementary to at least one functional TCR Vγ-encoding or TCR Vβ-encoding gene segment and wherein the plurality of V-segment primers specifically hybridize to substantially all functional TCR Vγ-encoding or TCR Vβ-encoding gene segments that are present in the sample, and (ii) a plurality of J-segment oligonucleotide primers that are each independently capable of specifically hybridizing to at least one polynucleotide encoding a human T cell receptor (TCR) J-region polypeptide, wherein each J-segment primer comprises a nucleotide sequence of at least 15 contiguous nucleotides that is complementary to at least one functional TCR Jγ-encoding or TCR Jβ-encoding gene segment and wherein the plurality of J-segment primers specifically hybridize to substantially all functional TCR Jγ-encoding or TCR Jβ-encoding gene segments that are present in the sample, wherein the V-segment and J-segment primers are capable of promoting amplification in said multiplex polymerase chain reaction (PCR) of substantially all rearranged TCRγ CDR3-encoding regions or substantially all TCRβ CDR3-encoding regions in the sample to produce a multiplicity of amplified rearranged DNA molecules from a population of T cells in the sample, said multiplicity of amplified rearranged DNA molecules being sufficient to quantify diversity of the TCRγ CDR3-encoding region or TCRγ CDR3-encoding region in the population of T cells, and wherein each amplified rearranged DNA molecule in the multiplicity of amplified rearranged DNA molecules is less than 600 nucleotides in length; and (b) sequencing said multiplicity of amplified rearranged DNA molecules to determine, for each unique rearranged DNA molecule in said multiplicity of amplified rearranged DNA molecules, (i) a rearranged DNA sequence and (ii) a relative frequency of occurrence of the rearranged DNA sequence; and (II) determining the relative frequency of occurrence for each unique rearranged DNA sequence from said one or a plurality of biological samples that are each obtained from the subject, wherein (A) presence, in a sample obtained from the subject, of at least one unique rearranged DNA sequence that has a relative frequency of at least 15% of rearranged TCRγ CDR3-encoding regions or rearranged TCRβ CDR3-encoding regions is diagnostic for a clonal lymphoid hematological malignancy in the subject, wherein (B) presence, in a sample obtained from the subject, of said at least one unique rearranged DNA sequence that is diagnostic for the clonal lymphoid hematological malignancy at a relative frequency of at least one in $10^5$ TCR CDR3-encoding regions, indicates minimal residual disease for the lymphoid hematological malignancy, and wherein (C) absence from the sample obtained from the subject of at least one unique rearranged DNA sequence that has a relative frequency of at least 15% of rearranged TCRγ CDR3-encoding regions or rearranged TCRβ CDR3-encoding regions indicates the subject should be evaluated for early thymic-precursor immunophenotype.

In certain embodiments each functional TCR or Ig V-encoding gene segment comprises a V gene recombination signal sequence (RSS) and each functional TCR or Ig J-encoding gene segment comprises a J gene RSS, and wherein each amplified rearranged DNA molecule comprises (i) at least 10, 20, 30 or 40 contiguous nucleotides of a sense strand of the TCR or Ig V-encoding gene segment, said at least 10, 20, 30 or 40 contiguous nucleotides being situated 5' to the V gene RSS and (ii) at least 10, 20 or 30 contiguous nucleotides of a sense strand of the TCR or Ig J-encoding gene segment, said at least 10, 20 or 30 contiguous nucleotides being situated 3' to the J gene RSS. In certain embodiments the plurality of V-segment oligonucleotide primers and the plurality of J-segment oligonucleotide primers comprise at least one of (1) the sequences set forth in SEQ ID NOs:5579-5643, (2) the sequences set forth in SEQ ID NOs:5644-5792, (3) the sequences set forth in SEQ ID NOs:5793-5816, (4) the sequences set forth in SEQ ID NOs:5817-6123, (5) the sequences set forth in SEQ ID NOs:6124-6127 and 6212-6215, (6) the sequences set forth in SEQ ID NOs:6128-6211 and 6216-6221, (7) the sequences set forth in SEQ ID NOs:6222-6286, and (8) the sequences set forth in SEQ ID NOs:6222-6351. In certain embodiments either or both of (i) the V-segment oligonucleotide primers comprise one or a plurality of oligonucleotides that exhibit at least 90% sequence identity to one or more of the nucleotide sequences set forth in SEQ ID NOS:5579-5630, 5644-5779, 5799-5816, 6124-6127, and 6222-6273, and (ii) the J-segment primers comprise one or a plurality of oligonucleotides that exhibit at least 90% sequence identity to one or more of the nucleotide sequences set forth in SEQ ID NOS:5631-5643, 5780-5798, 6212-6215, and 6274-6286.

Turning to another embodiment there is provided a method for detecting minimal residual disease for a lymphoid hematological malignancy in a subject after therapy, the method comprising: (I) for each of (i) one or a plurality of biological samples that each comprise a plurality of lymphoid hematopoietic cells and that are each obtained from the subject at one or more timepoints prior to therapy, and (ii) one or a plurality of biological samples that each comprise a plurality of lymphoid hematopoietic cells and that are each obtained from the subject at one or more timepoints after therapy, (a) amplifying DNA extracted from the biological sample in a multiplex polymerase chain reaction (PCR) that comprises: (i) a plurality of V-segment oligonucleotide primers that are each independently capable of specifically hybridizing to at least one polynucleotide encoding a human T cell receptor (TCR) V-region polypeptide, wherein each V-segment primer comprises a nucleotide sequence of at least 15 contiguous nucleotides that is complementary to at least one functional TCR Vγ-encoding or TCR Vβ-encoding gene segment and wherein the plurality of V-segment primers specifically hybridize to substantially all functional TCR Vγ-encoding or TCR Vβ-encoding gene segments that are present in the sample, and (ii) a plurality of J-segment oligonucleotide primers that are each independently capable of specifically hybridizing to at least one polynucleotide encoding a human T cell receptor (TCR) J-region polypeptide, wherein each J-segment primer comprises a nucleotide sequence of at least 15 contiguous nucleotides that is complementary to at least one functional TCR Jγ-encoding or TCR Jβ-encoding gene segment and wherein the plurality of J-segment primers specifically hybridize to substantially all functional TCR Jγ-encoding or TCR Jβ-encoding gene segments that are present in the sample, wherein the V-segment and J-segment primers are capable of promoting amplification in said multiplex polymerase chain reaction (PCR) of substantially all rearranged TCRγ CDR3-encoding regions or substantially all TCRβ CDR3-encoding regions in the sample to produce a multiplicity of amplified rearranged DNA molecules from a population of T cells in the sample, said multiplicity of amplified rearranged DNA molecules being sufficient to quantify diversity of the TCRγ CDR3-encoding region or TCRγ CDR3-encoding region in the population of T cells, and wherein each amplified rearranged DNA molecule in the multiplicity of amplified rearranged DNA molecules is less than 600 nucleotides in length; and (b) sequencing said multiplicity of amplified rearranged DNA molecules to determine, for each unique rearranged DNA molecule in said multiplicity of amplified rearranged DNA molecules, (i) a rearranged DNA sequence and (ii) a relative frequency of occurrence of the rearranged DNA sequence; and (II) comparing (i) the relative frequency of occurrence for each unique rearranged DNA sequence from said one or a plurality of biological samples that are each obtained from the subject at one or more timepoints prior to therapy, to (ii) the relative frequency of occurrence for each unique rearranged DNA sequence from said one or a plurality of biological samples that are each obtained from the subject at one or more timepoints after therapy, wherein (A) presence, in a sample obtained from the subject prior to therapy, of at least one unique rearranged DNA sequence that has a relative frequency of at least 15% of rearranged TCRγ CDR3-encoding regions or rearranged TCRβ CDR3-encoding regions is diagnostic for a clonal lymphoid hematological malignancy in the subject prior to therapy, and wherein (B) presence, in a sample obtained from the subject after therapy, of said at least one unique rearranged DNA sequence that is diagnostic for the clonal lymphoid hematological malignancy at a relative frequency of at least one in $10^6$ or of at least one in $10^5$ TCR CDR3-encoding regions, indicates minimal residual disease for the lymphoid hematological malignancy.

In certain embodiments each functional TCR or Ig V-encoding gene segment comprises a V gene recombination signal sequence (RSS) and each functional TCR or Ig J-encoding gene segment comprises a J gene RSS, and wherein each amplified rearranged DNA molecule comprises (i) at least 10, 20, 30 or 40 contiguous nucleotides of a sense strand of the TCR or Ig V-encoding gene segment, said at least 10, 20, 30 or 40 contiguous nucleotides being situated 5' to the V gene RSS and (ii) at least 10, 20 or 30 contiguous nucleotides of a sense strand of the TCR or Ig J-encoding gene segment, said at least 10, 20 or 30 contiguous nucleotides being situated 3' to the J gene RSS. In certain embodiments the plurality of V-segment oligonucleotide primers and the plurality of J-segment oligonucleotide primers comprise at least one of (1) the sequences set forth in SEQ ID NOs:5579-5643, (2) the sequences set forth in SEQ ID NOs:5644-5792, (3) the sequences set forth in SEQ ID NOs:5793-5816, (4) the sequences set forth in SEQ ID NOs:5817-6123, (5) the sequences set forth in SEQ ID NOs:6124-6127 and 6212-6215, (6) the sequences set forth in SEQ ID NOs:6128-6211 and 6216-6221, (7) the sequences set forth in SEQ ID NOs:6222-6286, and (8) the sequences set forth in SEQ ID NOs:6222-6351. In certain embodiments either or both of (i) the V-segment oligonucleotide primers comprise one or a plurality of oligonucleotides that exhibit at least 90% sequence identity to one or more of the nucleotide sequences set forth in SEQ ID NOS:5579-5630, 5644-5779, 5799-5816, 6124-6127, and 6222-6273, and (ii) the J-segment primers comprise one or a plurality of oligonucleotides that exhibit at least 90% sequence identity to one or more of the nucleotide sequences set forth in SEQ ID NOS:5631-5643, 5780-5798, 6212-6215, and 6274-6286.

In another embodiment of the present invention there is provided a method for diagnosing a lymphoid hematological malignancy in a subject prior to therapy, and for detecting minimal residual disease for the lymphoid hematological malignancy in the subject after therapy, the method comprising (I) for each of (i) one or a plurality of biological samples that each comprise a plurality of lymphoid hematopoietic cells and that are each obtained from the subject at one or more timepoints prior to therapy, and (ii) one or a plurality of biological samples that each comprise a plurality of lymphoid hematopoietic cells and that are each obtained from the subject at one or more timepoints after therapy, (a) amplifying DNA extracted from the biological sample in a multiplex polymerase chain reaction (PCR) that comprises: (i) a plurality of V-segment oligonucleotide primers that are each independently capable of specifically hybridizing to at least one polynucleotide encoding a human T cell receptor (TCR) V-region polypeptide or a human immunoglobulin (Ig) V-region polypeptide, wherein each V-segment primer comprises a nucleotide sequence of at least 15 contiguous nucleotides that is complementary to at least one functional TCR V region-encoding or Ig V region-encoding gene segment and wherein the plurality of V-segment primers specifically hybridize to substantially all functional TCR V-encoding or Ig V-encoding gene segments that are present in the sample, and (ii) a plurality of J-segment oligonucleotide primers that are each independently capable of specifically hybridizing to at least one polynucleotide encoding a human T cell receptor (TCR) J-region polypeptide or a human Ig J-region polypeptide, wherein each J-segment primer comprises a nucleotide sequence of at least 15 contiguous nucleotides that is complementary to at least one functional TCR J-encoding or Ig J-encoding gene segment and wherein the plurality of J-segment primers specifically hybridize to substantially all functional TCR J-encoding or Ig J-encoding gene segments that are present in the sample, wherein the V-segment and J-segment primers are capable of promoting amplification in said multiplex polymerase chain reaction (PCR) of substantially all rearranged TCR CDR3-encoding regions or substantially all Ig CDR3-encoding regions in the sample to produce a multiplicity of amplified rearranged DNA molecules from a population of lymphoid cells in the sample, said multiplicity of amplified rearranged DNA molecules being sufficient to quantify diversity of the TCR CDR3-encoding region or Ig CDR3-encoding region in the population of lymphoid cells, and wherein each amplified rearranged DNA molecule in the multiplicity of amplified rearranged DNA molecules is less than 600 nucleotides in length; and (b) sequencing said multiplicity of amplified rearranged DNA molecules to determine, for each unique rearranged DNA molecule in said multiplicity of amplified rearranged DNA molecules, (i) a rearranged DNA sequence and (ii) a relative frequency of occurrence of the rearranged DNA sequence; and (II) comparing (i) the relative frequency of occurrence for each unique rearranged DNA sequence from said one or a plurality of biological samples that are each obtained from the subject at one or more timepoints prior to therapy, to (ii) the relative frequency of occurrence for each unique rearranged DNA sequence from said one or a plurality of biological samples that are each obtained from the subject at one or more timepoints after therapy, wherein (A) presence, in a sample obtained from the subject prior to therapy, of at least one unique rearranged DNA sequence that has a relative frequency of at least 15%, 16%, 17%, 18%, 19%, 20%, 21%, 22%, 23%, 24%, 25%, 26%, 27%, 28%, 29% or 30% of rearranged TCR CDR3-encoding regions or rearranged Ig CDR3-encoding regions is diagnostic for a clonal lymphoid hematological malignancy in the subject prior to therapy, and wherein (B) presence, in a sample obtained from the subject after therapy, of at least one unique rearranged DNA sequence that is diagnostic for the clonal lymphoid hematological malignancy at a relative frequency of at least one in $10^5$ TCR or Ig CDR3-encoding regions, indicates minimal residual disease for the lymphoid hematological malignancy.

In certain embodiments each functional TCR or Ig V-encoding gene segment comprises a V gene recombination signal sequence (RSS) and each functional TCR or Ig J-encoding gene segment comprises a J gene RSS, and wherein each amplified rearranged DNA molecule comprises (i) at least 10, 20, 30 or 40 contiguous nucleotides of a sense strand of the TCR or Ig V-encoding gene segment, said at least 10, 20, 30 or 40 contiguous nucleotides being situated 5' to the V gene RSS and (ii) at least 10, 20 or 30 contiguous nucleotides of a sense strand of the TCR or Ig J-encoding gene segment, said at least 10, 20 or 30 contiguous nucleotides being situated 3' to the J gene RSS. In certain embodiments the rearranged TCR or Ig CDR3-encoding regions are selected from rearranged TCRα CDR3-encoding regions, TCRβ CDR3-encoding regions, TCRγ CDR3-encoding regions, TCRδ, CDR3-encoding regions, IgH CDR3-encoding regions, Igκ CDR3-encoding regions, and Igλ CDR3-encoding regions. In certain embodiments the plurality of V-segment oligonucleotide primers and the plurality of J-segment oligonucleotide primers comprise at least one of (1) the sequences set forth in SEQ ID NOs:5579-5643, (2) the sequences set forth in SEQ ID NOs:5644-5792, (3) the sequences set forth in SEQ ID NOs:5793-5816, (4) the sequences set forth in SEQ ID NOs:5817-6123, (5) the sequences set forth in SEQ ID NOs:6124-6127 and 6212-6215, (6) the sequences set forth in SEQ ID NOs:6128-6211 and 6216-6221, (7) the sequences set forth in SEQ ID NOs:6222-6286, and (8) the sequences set forth in SEQ ID NOs:6222-6351. In certain embodiments either or both of (i) the V-segment oligonucleotide primers comprise one or a plurality of oligonucleotides that exhibit at least 90% sequence identity to one or more of the nucleotide sequences set forth in SEQ ID NOS:5579-5630, 5644-5779, 5799-5816, 5833-6211, and 6222-6273, and (ii) the J-segment primers comprise one or a plurality of oligonucleotides that exhibit at least 90% sequence identity to one or more of the nucleotide sequences set forth in SEQ ID NOS:5631-5643, 5780-5798, 5817-5832, 6212-6221, and 6274-6286.

In certain embodiments of the above described methods, either or both of (i) the V-segment oligonucleotide primers comprise one or a plurality of oligonucleotides that exhibit at least 90% sequence identity to one or more of: (1) the nucleotide sequences set forth in SEQ ID NOS:5579-5630, (2) the nucleotide sequences set forth in SEQ ID NOS:5644-5779, (3) the nucleotide sequences set forth in SEQ ID NOS:5799-5816, (4) the nucleotide sequences set forth in SEQ ID NOS:5833-6123, (5) the nucleotide sequences set forth in SEQ ID NOS:6124-6127, (6) the nucleotide sequences set forth in SEQ ID NOS:6128-6211, (7) the nucleotide sequences set forth in SEQ ID NOS:6222-6273, and (8) the nucleotide sequences set forth in SEQ ID NOS:6287-6351; and (ii) the J-segment primers comprise one or a plurality of oligonucleotides that exhibit at least 90% sequence identity to one or more of: (1) the nucleotide sequences set forth in SEQ ID NOS:5631-5643, (2) the nucleotide sequences set forth in SEQ ID NOS:5780-5792, (3) the nucleotide sequences set forth in SEQ ID NOS:5793-

5798, (4) the nucleotide sequences set forth in SEQ ID NOS:5817-5832, (5) the nucleotide sequences set forth in SEQ ID NOS:6212-6215, (6) the nucleotide sequences set forth in SEQ ID NOS:6216-6221, and (7) the nucleotide sequences set forth in SEQ ID NOS:6274-6286.

In certain embodiments of the above described methods, the lymphoid hematological malignancy is selected from acute T-cell lymphoblastic leukemia (T-ALL), acute B-cell lymphoblastic leukemia (B-ALL), multiple myeloma, plasmacytoma, macroglobulinemia, chronic lymphocytic leukemia (CLL), acute lymphoblastic leukemia (ALL), multiple myeloma, plasmacytoma, macroglobulinemia, chronic lymphocytic leukemia (CLL), Hodgkins lymphoma, non-Hodgkins lymphoma, cutaneous T-cell lymphoma, mantle cell lymphoma, peripheral T-cell lymphoma, hairy cell leukemia, T prolymphocytic lymphoma, angioimmunoblastic T-cell lymphoma, T lymphoblastic leukemia/lymphoma, peripheral T-cell lymphoma, adult T cell leukemia/lymphoma, mycosis fungoides, Sezary syndrome, T lymphoblastic leukemia, myeloproliferative neoplasm and myelodysplastic syndrome.

In certain embodiments of the above described methods the multiplex PCR further comprises a template composition for amplification factor determination in which a known number of each of a plurality of template oligonucleotides having a unique oligonucleotide sequence is present, the template composition comprising a plurality of template oligonucleotides having a plurality of oligonucleotide sequences of general formula: 5'-U1-B1-V-B2-R-B3-J-B4-U2-3' [I] wherein: (a) V is a polynucleotide comprising at least 20, 30, 60, 90, 120, 150, 180, or 210, and not more than 1000, 900, 800, 700, 600 or 500 contiguous nucleotides of an adaptive immune receptor variable (V) region encoding gene sequence, or the complement thereof, and in each of the plurality of oligonucleotide sequences V comprises a unique oligonucleotide sequence; (b) J is a polynucleotide comprising at least 15-30, 31-60, 61-90, 91-120, or 120-150, and not more than 600, 500, 400, 300 or 200 contiguous nucleotides of an adaptive immune receptor joining (J) region encoding gene sequence, or the complement thereof, and in each of the plurality of oligonucleotide sequences J comprises a unique oligonucleotide sequence; (c) U1 is either nothing or comprises an oligonucleotide having a sequence that is selected from (i) a first universal adaptor oligonucleotide sequence, and (ii) a first sequencing platform-specific oligonucleotide sequence that is linked to and positioned 5' to a first universal adaptor oligonucleotide sequence; (d) U2 is either nothing or comprises an oligonucleotide having a sequence that is selected from (i) a second universal adaptor oligonucleotide sequence, and (ii) a second sequencing platform-specific oligonucleotide sequence that is linked to and positioned 5' to a second universal adaptor oligonucleotide sequence; (e) B1, B2, B3, and B4 are each independently either nothing or each comprises an oligonucleotide B that comprises an oligonucleotide barcode sequence of 3, 4, 5, 6, 7, 8, 9, 10, 11, 12, 13, 14, 15, 16, 17, 18, 19, 20, 21, 22, 23, 24 or 25, contiguous nucleotides, wherein in each of the plurality of oligonucleotide sequences B comprises a unique oligonucleotide sequence that uniquely identifies, as a paired combination, (i) the unique V oligonucleotide sequence of (a) and (ii) the unique J oligonucleotide sequence of (b); (f) R is either nothing or comprises a restriction enzyme recognition site that comprises an oligonucleotide sequence that is absent from (a)-(e), and wherein: (g) at least one of: (i) the plurality of template oligonucleotides comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51-100, 101-200, 201-300, 301-400, 401-500, 501-600, 601-700, 701-800, 801-900, 901-1000, 1001-1100, 1101-1200, 1201-1300, 1301-1400, 1401-1500, 1501-1600, 1601-1700, 1701-2000, or 2001-2500 unique oligonucleotide sequences, (ii) the plurality of template oligonucleotides comprises at least one template oligonucleotide having an oligonucleotide sequence of general formula (I) to which each V-segment oligonucleotide primer can specifically hybridize and at least one template oligonucleotide having an oligonucleotide sequence of general formula (I) to which each J-segment oligonucleotide primer can specifically hybridize, or (iii) the plurality of template oligonucleotides comprises at least a or at least b unique oligonucleotide sequences, whichever is larger, where a is the number of unique adaptive immune receptor V region-encoding gene segments in the subject and b is the number of unique adaptive immune receptor J region-encoding gene segments in the subject, and the composition comprises at least one template oligonucleotide for each unique V polynucleotide and at least one template oligonucleotide for each unique J polynucleotide; said method further comprising quantifying rearranged DNA molecules encoding one or a plurality of adaptive immune receptors in the DNA extracted from the biological sample by the steps of: (1) quantitatively sequencing all or a sufficient portion of each of said amplified template DNA molecules and each of said amplified rearranged DNA molecules to quantify (a) a template product number of amplified template DNA molecules which contain at least one oligonucleotide barcode sequence, and (b) a rearranged product number of amplified rearranged DNA molecules which lack an oligonucleotide barcode sequence; (2) calculating an amplification factor by dividing the template product number of (1)(a) by the known number of each of the plurality of template oligonucleotides having a unique oligonucleotide sequence; and (3) dividing the rearranged product number of (1)(b) by the amplification factor calculated in (2) to quantify unique adaptive immune receptor encoding DNA molecules in the sample.

In certain further embodiments, in the template composition for amplification factor determination, all template oligonucleotides in the plurality of template oligonucleotides are of substantially identical length. In certain embodiments each primer in the oligonucleotide amplification primer set is capable of specifically hybridizing to at least one template oligonucleotide in the plurality of oligonucleotides of the template composition. In certain embodiments each template oligonucleotide in the plurality of template oligonucleotides further comprises a stop codon between V and B2. In certain embodiments, in the template composition for amplification factor determination, each template oligonucleotide in the plurality of template oligonucleotides is present in a substantially equimolar amount. In certain embodiments the adaptive immune receptor is selected from TCRB, TCRG, TCRA, TCRD, IGH, IGK, and IGL, wherein (i) the V polynucleotide of (a) encodes, respectively, a TCRB, TCRG, TCRA, TCRD, IGH, IGK, or IGL receptor V-region polypeptide, and (ii) the J polynucleotide of (b) encodes, respectively, a TCRB, TCRG, TCRA, TCRD, IGH, IGK, or IGL receptor J-region polypeptide.

In certain embodiments the oligonucleotide amplification primer set is capable of amplifying productively rearranged DNA encoding one or a plurality of adaptive immune receptors, wherein in said step (A) of amplifying, the oligonucleotide amplification primer set does not include any oligonucleotide primers that specifically hybridize to a V-region pseudogene or orphon or to a J-region pseudogene or orphon. In certain embodiments the plurality of template oligonucleotides have a plurality of sequences of general formula (I) that is selected from: (1) the plurality of oligonucleotide sequences of general formula (I) in which polynucleotides V and J have the TCRB V and J sequences set forth in at least one set of 68 TCRB V and J SEQ ID NOS, respectively, as set forth in FIG. 9 as TCRB V/J set 1, TCRB V/J set 2, TCRB V/J set 3, TCRB V/J set 4, TCRB V/J set 5, TCRB V/J set 6, TCRB V/J set 7, TCRB V/J set 8, TCRB V/J set 9, TCRB V/J set 10, TCRB V/J set 11, TCRB V/J set 12 and TCRB V/J set 13; (2) the plurality of oligonucleotide sequences of general formula (I) in which polynucleotides V and J have the TCRG V and J sequences set forth in at least one set of 14 TCRG V and J SEQ ID NOS, respectively, as set forth in FIG. 10 as TCRG V/J set 1, TCRG V/J set 2, TCRG V/J set 3, TCRG V/J set 4 and TCRG V/J set 5; (3) the plurality of oligonucleotide sequences of general formula (I) in which polynucleotides V and J have the IGH V and J sequences set forth in at least one set of 127 IGH V and J SEQ ID NOS, respectively, as set forth in FIG. 11 as IGH V/J set 1, IGH V/J set 2, IGH V/J set 3, IGH V/J set 4, IGH V/J set 5, IGH V/J set 6, IGH V/J set 7, IGH V/J set 8 and IGH V/J set 9; (4) the plurality of oligonucleotide sequences of general formula (I) as set forth in SEQ ID NOS:3157-4014; (5) the plurality of oligonucleotide sequences of general formula (I) as set forth in SEQ ID NOS:4015-4084; and (6) the plurality of oligonucleotide sequences of general formula (I) as set forth in SEQ ID NOS:4085-5200.

In certain embodiments of the above described methods, the plurality of V-segment and J-segment oligonucleotide primers is capable of amplifying productively rearranged DNA encoding one or a plurality of adaptive immune receptors, and in said step (a) of amplifying, the V-segment and J-segment oligonucleotide primers do not include any oligonucleotide primers that specifically hybridize to a V-region pseudogene or orphon or to a J-region pseudogene or orphon.

Accordingly in certain embodiments of certain of the above described methods, the method further comprises quantifying rearranged DNA molecules encoding one or a plurality of adaptive immune receptors in DNA extracted from each biological sample that comprises DNA from lymphoid cells of the subject, each adaptive immune receptor comprising a variable region and a joining region, said step of quantifying comprising: (A) amplifying DNA in a multiplex polymerase chain reaction (PCR) that comprises: (1) DNA from the biological sample that comprises lymphoid cells of the subject, (2) an oligonucleotide amplification primer set that is capable of amplifying rearranged DNA encoding one or a plurality of adaptive immune receptors in the DNA from the biological sample, the primer set comprising: (a) in substantially equimolar amounts, a plurality of V-segment oligonucleotide primers that are each independently capable of specifically hybridizing to at least one polynucleotide encoding an adaptive immune receptor V-region polypeptide or to the complement thereof, wherein each V-segment primer comprises a nucleotide sequence of at least 15 contiguous nucleotides that is complementary to at least one functional adaptive immune receptor V region-encoding gene segment and wherein the plurality of V-segment primers specifically hybridize to substantially all functional adaptive immune receptor V region-encoding gene segments that are present in the template composition, and (b) in substantially equimolar amounts, a plurality of J-segment oligonucleotide primers that are each independently capable of specifically hybridizing to at least one polynucleotide encoding an adaptive immune receptor J-region polypeptide or to the complement thereof, wherein each J-segment primer comprises a nucleotide sequence of at least 15 contiguous nucleotides that is complementary to at least one functional adaptive immune receptor J region-encoding gene segment and wherein the plurality of J-segment primers specifically hybridize to substantially all functional adaptive immune receptor J region-encoding gene segments that are present in the template composition, wherein the V-segment and J-segment oligonucleotide primers are capable of promoting amplification in said multiplex polymerase chain reaction (PCR) of (i) substantially all template oligonucleotides in the template composition to produce a multiplicity of amplified template DNA molecules, said multiplicity of amplified template DNA molecules being sufficient to quantify diversity of the template oligonucleotides in the template composition, and (ii) substantially all rearranged DNA molecules encoding adaptive immune receptors in the biological sample to produce a multiplicity of amplified rearranged DNA molecules, said multiplicity of amplified rearranged DNA molecules being sufficient to quantify diversity of the rearranged DNA molecules in the DNA from the biological sample, and wherein each amplified DNA molecule in the multiplicity of amplified template DNA molecules and in the multiplicity of amplified rearranged DNA molecules is less than 1000, 900, 800, 700, 600, 500, 400, 300, 200, 100, 90, 80 or 70 nucleotides in length, and (3) a template composition for amplification factor determination in which a known number of each of a plurality of template oligonucleotides having a unique oligonucleotide sequence is present, the template composition comprising: a plurality of template oligonucleotides having a plurality of oligonucleotide sequences of general formula: 5'-U1-B1-V-B2-R-B3-J-B4-U2-3' [I] wherein: (a) V is a polynucleotide comprising at least 20, 30, 60, 90, 120, 150, 180, or 210, and not more than 1000, 900, 800, 700, 600 or 500 contiguous nucleotides of an adaptive immune receptor variable (V) region encoding gene sequence, or the complement thereof, and in each of the plurality of oligonucleotide sequences V comprises a unique oligonucleotide sequence; (b) J is a polynucleotide comprising at least 15-30, 31-60, 61-90, 91-120, or 120-150, and not more than 600, 500, 400, 300 or 200 contiguous nucleotides of an adaptive immune receptor joining (J) region encoding gene sequence, or the complement thereof, and in each of the plurality of oligonucleotide sequences J comprises a unique oligonucleotide sequence; (c) U1 is either nothing or comprises an oligonucleotide having a sequence that is selected from (i) a first universal adaptor oligonucleotide sequence, and (ii) a first sequencing platform-specific oligonucleotide sequence that is linked to and positioned 5' to a first universal adaptor oligonucleotide sequence; (d) U2 is either nothing or comprises an oligonucleotide having a sequence that is selected from (i) a second universal adaptor oligonucleotide sequence, and (ii) a second sequencing platform-specific oligonucleotide sequence that is linked to and positioned 5' to a second universal adaptor oligonucleotide sequence; (e) B1, B2, B3, and B4 are each independently either nothing or each comprises an oligonucleotide B that comprises an oligonucleotide barcode sequence of 3, 4, 5, 6, 7, 8, 9, 10, 11, 12, 13, 14, 15, 16, 17, 18, 19, 20, 21, 22, 23, 24 or 25, contiguous nucleotides, wherein in each of the plurality of oligonucleotide sequences B comprises a unique oligonucleotide sequence that uniquely identifies, as a paired combination, (i) the unique V oligonucleotide sequence of (a) and (ii) the unique J oligonucleotide sequence of (b); (f) R is either nothing or comprises a restriction enzyme recognition site that comprises an oligonucleotide sequence that is absent from (a)-(e), and wherein: (g) at least one of: (i) the plurality of template oligonucleotides comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51-100, 101-200, 201-300, 301-400, 401-500, 501-600, 601-700, 701-800, 801-900, 901-1000, 1001-1100, 1101-1200, 1201-1300, 1301-1400, 1401-1500, 1501-1600, 1601-1700, 1701-2000, or 2001-2500 unique oligonucleotide sequences, (ii) the plurality of template oligonucleotides comprises at least one template oligonucleotide having an oligonucleotide sequence of general formula (I) to which each V-segment oligonucleotide primer can specifically hybridize and at least one template oligonucleotide having an oligonucleotide sequence of general formula (I) to which each J-segment oligonucleotide primer can specifically hybridize, or (iii) the plurality of template oligonucleotides comprises at least a or at least b unique oligonucleotide sequences, whichever is larger, where a is the number of unique adaptive immune receptor V region-encoding gene segments in the subject and b is the number of unique adaptive immune receptor J region-encoding gene segments in the subject, and the composition comprises at least one template oligonucleotide for each unique V polynucleotide and at least one template oligonucleotide for each unique J polynucleotide; (B) quantitatively sequencing all or a sufficient portion of each of said amplified template DNA molecules and each of said amplified rearranged DNA molecules to quantify (i) a template product number of amplified template DNA molecules which contain at least one oligonucleotide barcode sequence, and (ii) a rearranged product number of amplified rearranged DNA molecules which lack an oligonucleotide barcode sequence; (C) calculating an amplification factor by dividing the template product number of (B)(i) by the known number of each of the plurality of template oligonucleotides having a unique oligonucleotide sequence of (A)(2); and (D) dividing the rearranged product number of (B)(ii) by the amplification factor calculated in (C) to quantify unique adaptive immune receptor encoding DNA molecules in the sample.

In certain further embodiments, in the template composition for amplification factor determination, all template oligonucleotides in the plurality of template oligonucleotides are of substantially identical length. In certain other further embodiments, each primer in the oligonucleotide amplification primer set is capable of specifically hybridizing to at least one template oligonucleotide in the plurality of oligonucleotides of the template composition. In certain other further embodiments, each template oligonucleotide in the plurality of template oligonucleotides further comprises a stop codon between V and B2. In certain other further embodiments, in the template composition for amplification factor determination, each template oligonucleotide in the plurality of template oligonucleotides is present in a substantially equimolar amount. In certain other further embodiments the adaptive immune receptor is selected from TCRB, TCRG, TCRA, TCRD, IGH, IGK, and IGL, wherein (i) the V polynucleotide of (a) encodes, respectively, a TCRB, TCRG, TCRA, TCRD, IGH, IGK, or IGL receptor V-region polypeptide, and (ii) the J polynucleotide of (b) encodes, respectively, a TCRB, TCRG, TCRA, TCRD, IGH, IGK, or IGL receptor J-region polypeptide. In certain other further embodiments the oligonucleotide amplification primer set is capable of amplifying productively rearranged DNA encoding one or a plurality of adaptive immune receptors, and wherein in said step (A) of amplifying, the oligonucleotide amplification primer set does not include any oligonucleotide primers that specifically hybridize to a V-region pseudogene or orphon or to a J-region pseudogene or orphon. In certain other further embodiments the plurality of template oligonucleotides have a plurality of sequences of general formula (I) that is selected from: (1) the plurality of oligonucleotide sequences of general formula (I) in which polynucleotides V and J have the TCRB V and J sequences set forth in at least one set of 68 TCRB V and J SEQ ID NOS, respectively, as set forth in FIG. 9 as TCRB V/J set 1, TCRB V/J set 2, TCRB V/J set 3, TCRB V/J set 4, TCRB V/J set 5, TCRB V/J set 6, TCRB V/J set 7, TCRB V/J set 8, TCRB V/J set 9, TCRB V/J set 10, TCRB V/J set 11, TCRB V/J set 12 and TCRB V/J set 13; (2) the plurality of oligonucleotide sequences of general formula (I) in which polynucleotides V and J have the TCRG V and J sequences set forth in at least one set of 14 TCRG V and J SEQ ID NOS, respectively, as set forth in FIG. 10 as TCRG V/J set 1, TCRG V/J set 2, TCRG V/J set 3, TCRG V/J set 4 and TCRG V/J set 5; (3) the plurality of oligonucleotide sequences of general formula (I) in which polynucleotides V and J have the IGH V and J sequences set forth in at least one set of 127 IGH V and J SEQ ID NOS, respectively, as set forth in FIG. 11 as IGH V/J set 1, IGH V/J set 2, IGH V/J set 3, IGH V/J set 4, IGH V/J set 5, IGH V/J set 6, IGH V/J set 7, IGH V/J set 8 and IGH V/J set 9; (4) the plurality of oligonucleotide sequences of general formula (I) as set forth in SEQ ID NOS:3157-4014; (5) the plurality of oligonucleotide sequences of general formula (I) as set forth in SEQ ID NOS:4015-4084; and (6) the plurality of oligonucleotide sequences of general formula (I) as set forth in SEQ ID NOS:4085-5200.

Turning to another embodiment there is provided a method comprising receiving a dataset comprising sequencing data for a plurality of amplicons obtained from a first sample comprising rearranged DNA sequences from a rearranged T cell receptor (TCR) complementarity determining region 3 (CDR3)-encoding region, the first sample obtained from a subject; determining from the dataset: a presence of at least one unique rearranged DNA sequence indicative of a clonal lymphoid hematological malignancy in the first sample, and a relative frequency of occurrence of the at least one unique rearranged DNA sequence in the first sample; and comparing the relative frequency of occurrence of the at least one unique rearranged DNA sequence in the first sample with a relative frequency of occurrence of the unique rearranged DNA sequence in a second sample, wherein a relative frequency of occurrence of the at least one unique rearranged DNA sequence of at least 1 in $10^5$ TCR CDR-3 encoding regions is diagnostic of minimal residual disease for lymphoid hematological malignancy in the subject.

In certain embodiments the first sample comprises T cells. In certain embodiments the second sample comprises T cells. In certain embodiments the first sample comprises a plurality of lymphoid hematopoietic cells obtained from the subject at a time following treatment for the lymphoid hematological malignancy. In certain embodiments the second sample comprises a plurality of lymphoid hematopoietic cells obtained from the subject at a time point prior to treatment. In certain embodiments the step of determining from the dataset a presence of at least one unique rearranged DNA sequence indicative of a clonal lymphoid hematological malignancy in the first sample comprises identifying a clonal sequence that has a relative frequency of at least 15% of rearranged TCRγ CDR3-encoding regions or rearranged TCRβ CDR3-encoding regions. In certain embodiments the dataset is obtained by amplifying by a multiplex polymerase chain reaction (PCR) a plurality of gene segments of a rearranged TCRγ CDR3-encoding region or a rearranged TCRβ CDR3-encoding region, each gene segment comprising a variable (V)-region and a joining (J)-region, using a plurality of V-segment oligonucleotide primers, each V-segment oligonucleotide primer capable of hybridizing to one or more TCR V-region polynucleotides of the gene segments; a plurality of J-segment oligonucleotide primers, each J-segment primer capable of hybridizing to one or more TCR J-region polynucleotides of the gene segments; wherein the plurality of V-segment oligonucleotide primers and J-segment oligonucleotide primers promote amplification of the TCRγ CDR3-encoding regions or the TCRβ CDR3-encoding regions in the first sample to produce a plurality of amplicons; and sequencing the plurality of amplicons to determine a nucleotide sequence for each of the plurality of amplicons.

In a further embodiment the TCR V-region polynucleotide encodes a TCR Vγ polypeptide or a TCR Vβ polypeptide. In another further embodiment the TCR J-region polynucleotide encodes a TCR Jγ polynucleotide or a TCR Jβ polypeptide. In another further embodiment each of the plurality of V-segment oligonucleotide primers comprises a nucleotide sequence of at least 15 contiguous nucleotides. In certain embodiments the nucleotide sequence is complementary to a functional TCR Vγ encoding gene segment or a functional TCR Vβ encoding gene segment. In certain embodiments the functional TCR Vγ encoding gene segment or the functional TCR Vβ encoding gene segment comprises a V gene recombination signal sequence (RSS). In certain embodiments each of the plurality of J-segment oligonucleotide primers comprises a nucleotide sequence of at least 15 contiguous nucleotides. In certain embodiments the nucleotide sequence is complementary to a functional TCR Jγ encoding gene segment or a functional TCR Jβ encoding gene segment. In certain further embodiments the functional TCR Jγ encoding gene segment or the functional TCR Jβ encoding gene segment comprises a J gene RSS.

According to certain embodiments the plurality of V-segment oligonucleotide primers are complementary to at least 10, 20, 30, or 40 contiguous nucleotides of a TCR V-encoding gene segment. In a further embodiment the at least 10, 20, 30, or 40 contiguous nucleotides are situated 5' to a V gene RSS. In certain other embodiments the plurality of J-segment oligonucleotide primers are complementary to at least 10, 20, or 30 contiguous nucleotides of a TCR J-encoding gene segment. In certain further embodiments the at least 10, 20, or 30 contiguous nucleotides of a TCR J-encoding gene segment are situated 3' to the J gene RSS.

In another embodiment the step of amplifying comprises amplifying substantially all of the gene segments comprising rearranged TCRγ CDR3-encoding regions or rearranged TCRβ CDR3-encoding regions in the first sample. In another embodiment the plurality of V-segment oligonucleotide primers hybridize to substantially all functional TCR Vγ encoding gene segments or TCR Vβ encoding gene segments in the first sample. In another embodiment the plurality of J-segment oligonucleotide primers hybridize to substantially all functional TCR Jγ encoding gene segments or TCR Jβ encoding gene segments in the first sample. In another embodiment the plurality of amplicons is sufficient to quantify diversity of the TCRγ CDR3-encoding regions or TCRβ CDR3-encoding region in the first sample. In another embodiment each sequenced amplicon is less than 600 nucleotides in length. In another embodiment the plurality of V-segment oligonucleotide primers and the plurality of J-segment oligonucleotide primers are selected from: (1) the sequences set forth in SEQ ID NOs:5579-5643, (2) the sequences set forth in SEQ ID NOs:5644-5792, (3) the sequences set forth in SEQ ID NOs:5793-5816, (4) the sequences set forth in SEQ ID NOs:5817-6123, (5) the sequences set forth in SEQ ID NOs:6124-6127 and 6212-6215, (6) the sequences set forth in SEQ ID NOs:6128-6211 and 6216-6221, (7) the sequences set forth in SEQ ID NOs:6222-6286, and (8) the sequences set forth in SEQ ID NOs:6222-6351.

In another embodiment one or more of the V-segment oligonucleotide primers comprise a nucleotide sequence comprising at least 90% sequence identity to the nucleotide sequence of SEQ ID NOs:5579-5630, 5644-5779, 5799-5816, 6124-6127, or 6222-6273. In another embodiment one or more of the J-segment oligonucleotide primers comprise a nucleotide sequence comprising at least 90% sequence identity to the nucleotide sequence of SEQ ID NOs:5631-5643, 5780-5798, 6212-6215, or 6274-6286. In another embodiment one or more of the V-segment oligonucleotide primers comprise a nucleotide sequence comprising at least 90% sequence identity to the nucleotide sequence of SEQ ID NOs:5579-5630, 5644-5779, 5799-5816, 6124-6127, or 6222-6273 and wherein one or more of the J-segment oligonucleotide primers comprise a nucleotide sequence comprising at least 90% sequence identity to the nucleotide sequence of SEQ ID NOs:5631-5643, 5780-5798, 6212-6215, or 6274-6286.

In another embodiment there is provided a method comprising: receiving a dataset comprising sequencing data for a plurality of amplicons obtained from a first sample comprising rearranged DNA sequences of a rearranged T cell receptor (TCR) complementarity determining region 3 (CDR3)-encoding region, the first sample obtained from a subject; determining from the dataset a relative frequency of occurrence of each unique sequenced amplicon; and determining whether the subject has a clonal lymphoid hematological malignancy based on a presence or an absence of at least one unique rearranged DNA sequence having a relative frequency of occurrence that exceeds 15% of rearranged TCR CDR3-encoding regions in the first sample, wherein a relative frequency of occurrence of the at least one unique rearranged DNA sequence that exceeds 15% is diagnostic for a clonal lymphoid hematological malignancy in the subject. In a further embodiment the relative frequency of occurrence of the at least one unique rearranged gene sequence is at least 16%, 17%, 18%, 19%, 20%, 21%, 22%, 23%, 24%, 25%, 26%, 27%, 28%, 29% or 30% of TCRγ CDR3-encoding regions or rearranged TCRβ CDR3-encoding regions in the sample. In another embodiment the method further comprises determining an absence from the sample of at least one unique rearranged DNA sequence that has a relative frequency of at least 15% of rearranged TCRγ CDR3-encoding regions or rearranged TCRβ CDR3-encoding regions. In certain embodiments the step of determining indicates that the subject should be evaluated for an early thymic-precursor immunophenotype.

In certain embodiments the dataset is obtained by amplifying by a multiplex polymerase chain reaction (PCR) a plurality of gene segments of a rearranged TCRγ CDR3-encoding region or a rearranged TCRβ CDR3-encoding region, each gene segment comprising a variable (V)-region and a joining (J)-region, using: a plurality of V-segment oligonucleotide primers, each V-segment oligonucleotide primer capable of hybridizing to one or more TCR V-region polynucleotides of the gene segments; a plurality of J-segment oligonucleotide primers, each J-segment primer capable of hybridizing to one or more TCR J-region polynucleotides of the gene segments; wherein the plurality of V-segment oligonucleotide primers and J-segment oligonucleotide primers promote amplification of the rearranged TCRγ CDR3-encoding regions or the rearranged TCRβ CDR3-encoding regions in the sample to produce a plurality of amplicons; and sequencing the plurality of amplicons to determine a nucleotide sequence for each of the plurality of amplicons. In certain further embodiments the plurality of V-segment oligonucleotide primers and the plurality of J-segment oligonucleotide primers are selected from: (1) the sequences set forth in SEQ ID NOs:5579-5643, (2) the sequences set forth in SEQ ID NOs:5644-5792, (3) the sequences set forth in SEQ ID NOs:5793-5816, (4) the sequences set forth in SEQ ID NOs:5817-6123, (5) the sequences set forth in SEQ ID NOs:6124-6127 and 6212-6215, (6) the sequences set forth in SEQ ID NOs:6128-6211 and 6216-6221, (7) the sequences set forth in SEQ ID NOs:6222-6286, and (8) the sequences set forth in SEQ ID NOs:6222-6351. In certain other further embodiments, one or more of the V-segment oligonucleotide primers comprise a nucleotide sequence comprising at least 90% sequence identity to the nucleotide sequence of SEQ ID NOs:5579-5630, 5644-5779, 5799-5816, 6124-6127, or 6222-6273.

According to a related embodiment, one or more of the J-segment oligonucleotide primers comprise a nucleotide sequence comprising at least 90% sequence identity to the nucleotide sequence of SEQ ID NOs:5631-5643, 5780-5798, 6212-6215, or 6274-6286. In another embodiment one or more of the V-segment oligonucleotide primers comprise a nucleotide sequence comprising at least 90% sequence identity to the nucleotide sequence of SEQ ID NOs:5579-5630, 5644-5779, 5799-5816, 6124-6127, or 6222-6273 and wherein one or more of the J-segment oligonucleotide primers comprise a nucleotide sequence comprising at least 90% sequence identity to the nucleotide sequence of SEQ ID NOs:5631-5643, 5780-5798, 6212-6215, or 6274-6286.

According to another embodiment there is provided a method comprising receiving a dataset comprising sequencing data for a plurality of amplicons obtained from a first sample comprising rearranged DNA sequences of a rearranged T cell receptor (TCR) complementarity determining region 3 (CDR3)-encoding region or an immunoglobulin (Ig) CDR3-encoding region, the first sample obtained from a subject; determining from the dataset: a presence of at least one unique rearranged DNA sequence indicative of a clonal lymphoid hematological malignancy in the first sample, and a relative frequency of occurrence of the at least one unique rearranged DNA sequence in the first sample; determining whether the subject has minimal residual disease by comparing the relative frequency of occurrence of the at least one unique rearranged DNA sequence in the sample with a relative frequency of occurrence of the unique rearranged DNA sequence in a second sample, wherein a relative frequency of occurrence of at least 1 in $10^5$ TCR CDR-3 or Ig CDR-3 encoding regions in the first sample is diagnostic of minimal residual disease for lymphoid hematological malignancy. In a further embodiment the dataset is obtained by amplifying by a multiplex polymerase chain reaction (PCR) a plurality of gene segments of rearranged T cell receptor (TCR) complementarity determining region 3 (CDR3)-encoding regions or Immunoglobulin (Ig) CDR3-encoding regions, each gene segment comprising a variable (V)-region and a joining (J)-region, using: a plurality of V-segment oligonucleotide primers, each V-segment oligonucleotide primer capable of hybridizing to one or more TCR V-region polynucleotides or one or more Ig V-region polynucleotides; a plurality of J-segment oligonucleotide primers, each J-segment primer capable of hybridizing to one or more TCR J-region polynucleotides or one or more Ig J-region polynucleotides of the gene segments; wherein the plurality of V-segment oligonucleotide primers and J-segment oligonucleotide primers promote amplification of the TCR CDR3-encoding regions or the Ig CDR3-encoding regions in the first sample to produce a plurality of amplicons; and sequencing the plurality of amplicons to determine a nucleotide sequence for each of the plurality of amplicons.

In one embodiment the TCR V-region polynucleotide encodes a TCR V-region polypeptide or an Ig V-region polypeptide. In one embodiment the TCR J-region polynucleotide encodes a TCR J-region polynucleotide or a Ig J-region polypeptide. In another embodiment the plurality of V-segment oligonucleotide primers and the plurality of J-segment oligonucleotide primers are selected from: (1) the sequences set forth in SEQ ID NOs:5579-5643, (2) the sequences set forth in SEQ ID NOs:5644-5792, (3) the sequences set forth in SEQ ID NOs:5793-5816, (4) the sequences set forth in SEQ ID NOs:5817-6123, (5) the sequences set forth in SEQ ID NOs:6124-6127 and 6212-6215, (6) the sequences set forth in SEQ ID NOs:6128-6211 and 6216-6221, (7) the sequences set forth in SEQ ID NOs:6222-6286, and (8) the sequences set forth in SEQ ID NOs:6222-6351. In another embodiment one or more of the V-segment oligonucleotide primers comprise a nucleotide sequence comprising at least 90% sequence identity to the nucleotide sequence of SEQ ID NOs:5579-5630, 5644-5779, 5799-5816, 6124-6127, or 6222-6273. In another embodiment one or more of the J-segment oligonucleotide primers comprise a nucleotide sequence comprising at least 90% sequence identity to the nucleotide sequence of SEQ ID NOs:5631-5643, 5780-5798, 6212-6215, or 6274-6286. In another embodiment one or more of the V-segment oligonucleotide primers comprise a nucleotide sequence comprising at least 90% sequence identity to the nucleotide sequence of SEQ ID NOs:5579-5630, 5644-5779, 5799-5816, 6124-6127, or 6222-6273 and wherein one or more of the J-segment oligonucleotide primers comprise a nucleotide sequence comprising at least 90% sequence identity to the nucleotide sequence of SEQ ID NOs:5631-5643, 5780-5798, 6212-6215, or 6274-6286.

According to certain further embodiments of the above described methods, the lymphoid hematological malignancy is selected from: acute T-cell lymphoblastic leukemia (T-ALL), acute B-cell lymphoblastic leukemia (B-ALL), multiple myeloma, plasmacytoma, macroglobulinemia, chronic lymphocytic leukemia (CLL), acute lymphoblastic leukemia (ALL), multiple myeloma, plasmacytoma, macroglobulinemia, chronic lymphocytic leukemia (CLL), Hodgkins lymphoma, non-Hodgkins lymphoma, cutaneous T-cell lymphoma, mantle cell lymphoma, peripheral T-cell lymphoma, hairy cell leukemia, T prolymphocytic lymphoma, angioimmunoblastic T-cell lymphoma, T lymphoblastic leukemia/lymphoma, peripheral T-cell lymphoma, adult T cell leukemia/lymphoma, mycosis fungoides, Sezary syndrome, T lymphoblastic leukemia, myeloproliferative neoplasm, and myelodysplastic syndrome.

In certain embodiments of the above described methods, the method further comprises: receiving a second dataset comprising sequencing data for standardizing amplification efficiencies of a plurality of primer sets, the second data set comprising sequencing data for a plurality of template amplicons. In certain further embodiments the second dataset is obtained by amplifying by multiplex PCR a plurality of unique template oligonucleotides to produce a plurality of unique template amplicons, each unique template oligonucleotide having a known concentration of molecules and a unique barcode sequence, and the plurality of primer sets comprising a plurality of V-segment oligonucleotide primers and a plurality of J-segment oligonucleotide primers; and quantitatively sequencing the plurality of unique template amplicons. In one embodiment the method further comprises adjusting the concentration of one or more V-segment oligonucleotide primers and one or more J-segment oligonucleotide primers to reduce biased amplification of TCR or Ig encoding gene segments in the first sample. In certain embodiments, amplifying by multiplex PCR of a plurality of unique template oligonucleotides comprises using equimolar concentrations of V-segment oligonucleotide primers and J-segment oligonucleotide primers. In certain embodiments the plurality of V-segment oligonucleotide primers and the plurality of J-segment oligonucleotide primers are selected from: (1) the sequences set forth in SEQ ID NOs:5579-5643, (2) the sequences set forth in SEQ ID NOs:5644-5792, (3) the sequences set forth in SEQ ID NOs:5793-5816, (4) the sequences set forth in SEQ ID NOs:5817-6123, (5) the sequences set forth in SEQ ID NOs:6124-6127 and 6212-6215, (6) the sequences set forth in SEQ ID NOs:6128-6211 and 6216-6221, (7) the sequences set forth in SEQ ID NOs:6222-6286, and (8) the sequences set forth in SEQ ID NOs:6222-6351.

In another embodiment the above described method further comprises: quantifying based on the first dataset and the second dataset: (a) a template product number of template amplicons that contain at least one oligonucleotide barcode sequence, and (b) a rearranged product number of sequenced amplicons that lack an oligonucleotide barcode sequence; calculating an amplification factor by dividing the template product number by the known number of each of the plurality of unique template oligonucleotides; and determining a number of unique rearranged TCR or Ig encoding sequences in the first sample by dividing the rearranged product number by the amplification factor. In one embodiment the method further comprises determining the number of unique T cell genomes or B cell genomes in the first sample.

According to certain related embodiments the plurality of unique template oligonucleotides comprise a general formula: 5'-U1-B1-V-B2-R-B3-J-B4-U2-3' (Formula I), wherein V comprises a polynucleotide comprising at least 20, 30, 60, 90, 120, 150, 180, or 210, and not more than 1000, 900, 800, 700, 600 or 500 contiguous nucleotides of a V-region encoding gene sequence, or a complement thereof, and wherein V comprises a unique oligonucleotide sequence, wherein J is a polynucleotide comprising at least 15-30, 31-60, 61-90, 91-120, or 120-150, and not more than 600, 500, 400, 300 or 200 contiguous nucleotides of a J-region encoding gene sequence, or a complement thereof, and wherein J comprises a unique oligonucleotide sequence, wherein U1 is either nothing or comprises an oligonucleotide having a sequence that is selected from (i) a first universal adaptor oligonucleotide sequence, and (ii) a first sequencing platform-specific oligonucleotide sequence that is linked to and positioned 5' to a first universal adaptor oligonucleotide sequence, wherein U2 is either nothing or comprises an oligonucleotide having a sequence that is selected from (i) a second universal adaptor oligonucleotide sequence, and (ii) a second sequencing platform-specific oligonucleotide sequence that is linked to and positioned 5' to a second universal adaptor oligonucleotide sequence, wherein B1, B2, B3, and B4 are each independently nothing or each comprises an oligonucleotide B that comprises an oligonucleotide barcode sequence of 3-25 contiguous nucleotides, wherein in each of the plurality of oligonucleotide sequences B comprises a unique oligonucleotide sequence that uniquely identifies, as a paired combination, a unique V oligonucleotide sequence and a unique J oligonucleotide sequence, and wherein R is either nothing or comprises a restriction enzyme recognition site that comprises an oligonucleotide sequence not found in the template oligonucleotide.

These and other aspects of the herein described invention embodiments will be evident upon reference to the following detailed description and attached drawings. All of the U.S. patents, U.S. patent application publications, U.S. patent applications, foreign patents, foreign patent applications and non-patent publications referred to in this specification and/or listed in the Application Data Sheet are incorporated herein by reference in their entirety, as if each was incorporated individually. Aspects and embodiments of the invention can be modified, if necessary, to employ concepts of the various patents, applications and publications to provide yet further embodiments.

BRIEF DESCRIPTION OF THE SEVERAL VIEWS OF THE DRAWINGS

FIG. 1A shows T-cell clonality as detected at day 0 using multi-parametric flow cytometry (mpFC) and high-throughput sequencing (HTS) of amplified and rearranged TCRβ CDR3-encoding DNA regions. Samples with a clonal population were identified by TCRB sequencing. Data are plotted as frequency of the clonal sequence in the total T cell population. FIG. 1B shows minimal residual disease (MRD) detection at day 29 in samples from patients that exhibited an identifiable clonal TCRβ rearrangement at day 0.

FIG. 4 (FIG. 4A-4B) shows clonal TCRB gene sequences characterized in Day 0 (pre-treatment) samples by high-throughput sequencing (HTS) of amplified and rearranged TCRβ CDR3-encoding DNA regions. TCRB (TCRβ) CDR3 sequences are shown for typical T-ALL cases. 31 of 43 (72.1%) pre-treatment samples had a detectable clonal TCRB sequence; at least 27 also had a clonal TCRG (TCRγ)

sequence. Shown are TCRB CDR3 sequences with nucleotide insertions (single underline) and D gene (double underline) regions highlighted.

Figure 5:
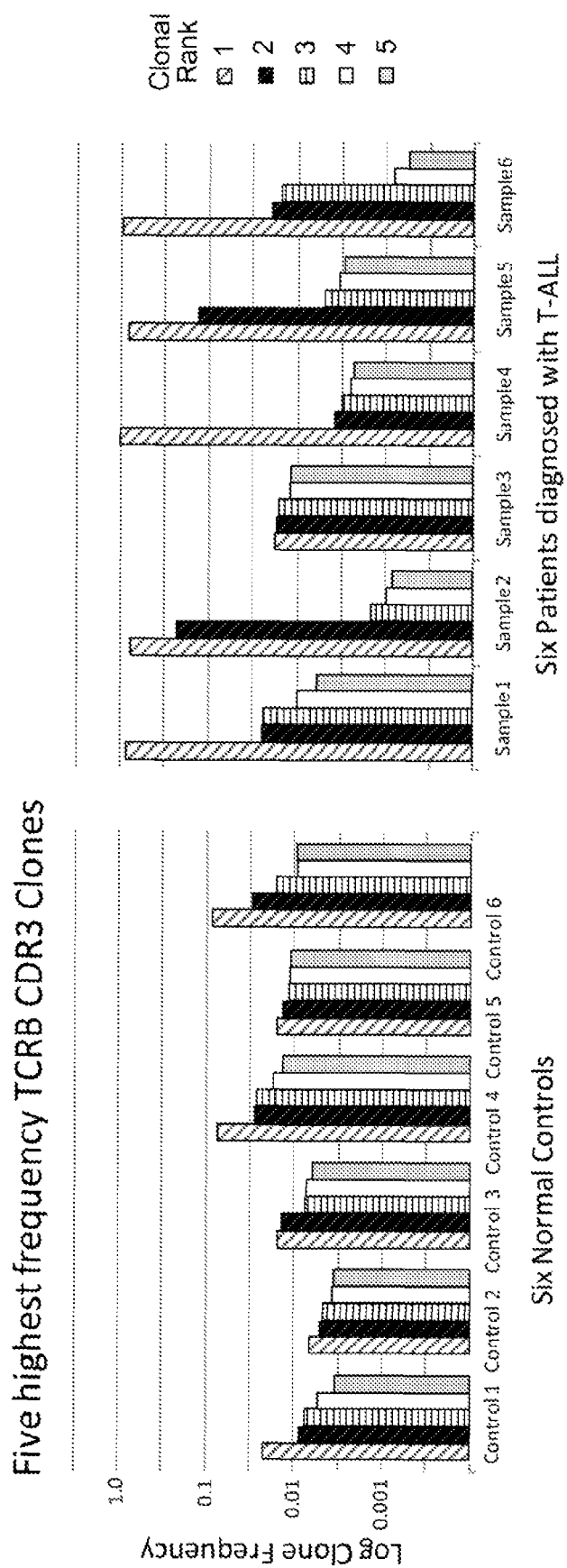

FIG. 5 shows a comparison of the normal and T-ALL clonal TCRB repertoires by the relative frequency of occurrence of the five highest frequency TCRB clones based on TCRB sequences identified by HTS in blood samples from six normal healthy control subjects (left) and six diagnosed T-ALL cases (right).

Figure 6:
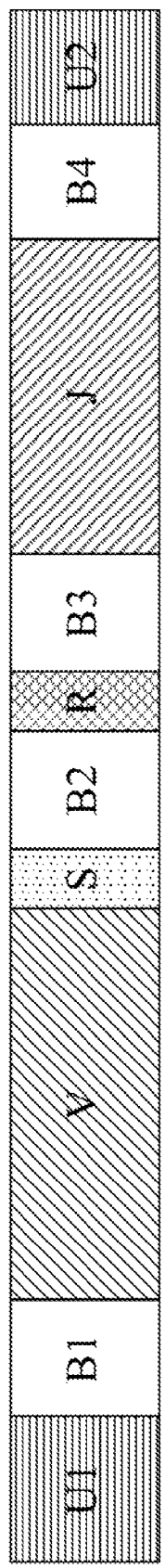

FIG. 6 shows a schematic diagram of an exemplary synthetic template oligonucleotide for use in determining an amplification factor for estimating the number of rearranged adaptive immune receptor (TCR or BCR) encoding sequences in a sample. U1, U2, universal adaptor oligonucleotides; B1-4, barcode oligonucleotides; V, variable region oligonucleotide; J, joining region oligonucleotide; R, restriction enzyme recognition site; S, optional stop codon.

Figure 7:
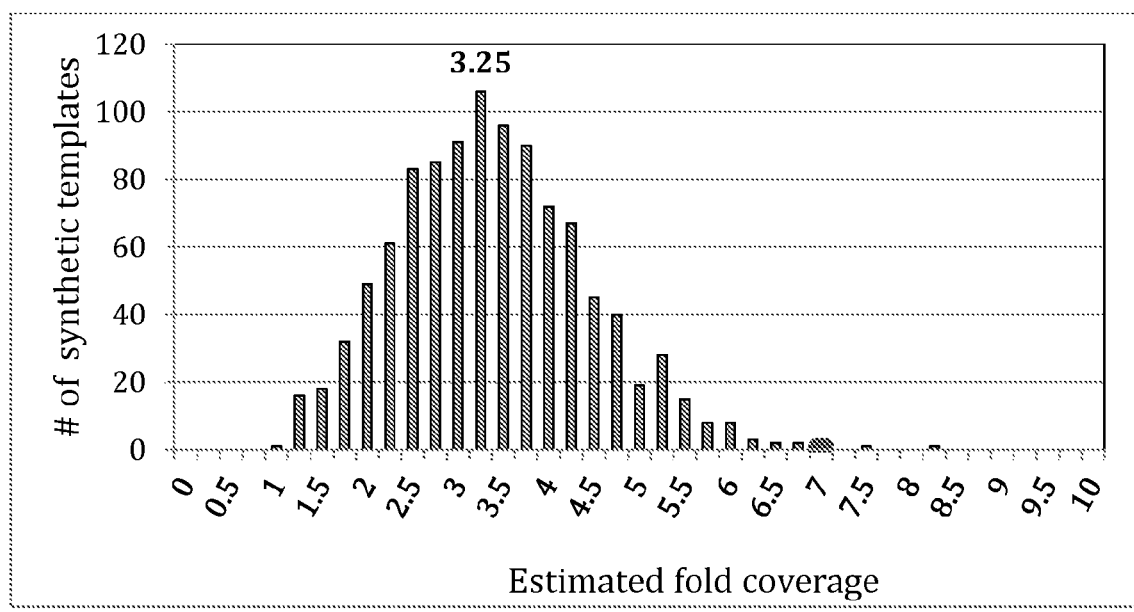

FIG. 7 shows the results of calculating an amplification factor for each VJ pair in a template composition that was added to a multiplexed PCR amplification of IGH sequences, and then averaging the amplification factor across all synthetic templates to estimate fold sequence coverage across all synthetic template molecules. Each bar represents the aggregate number of synthetic molecules with the same estimated fold sequence coverage. The median estimated fold sequence coverage was 3.25.

Figure 8:
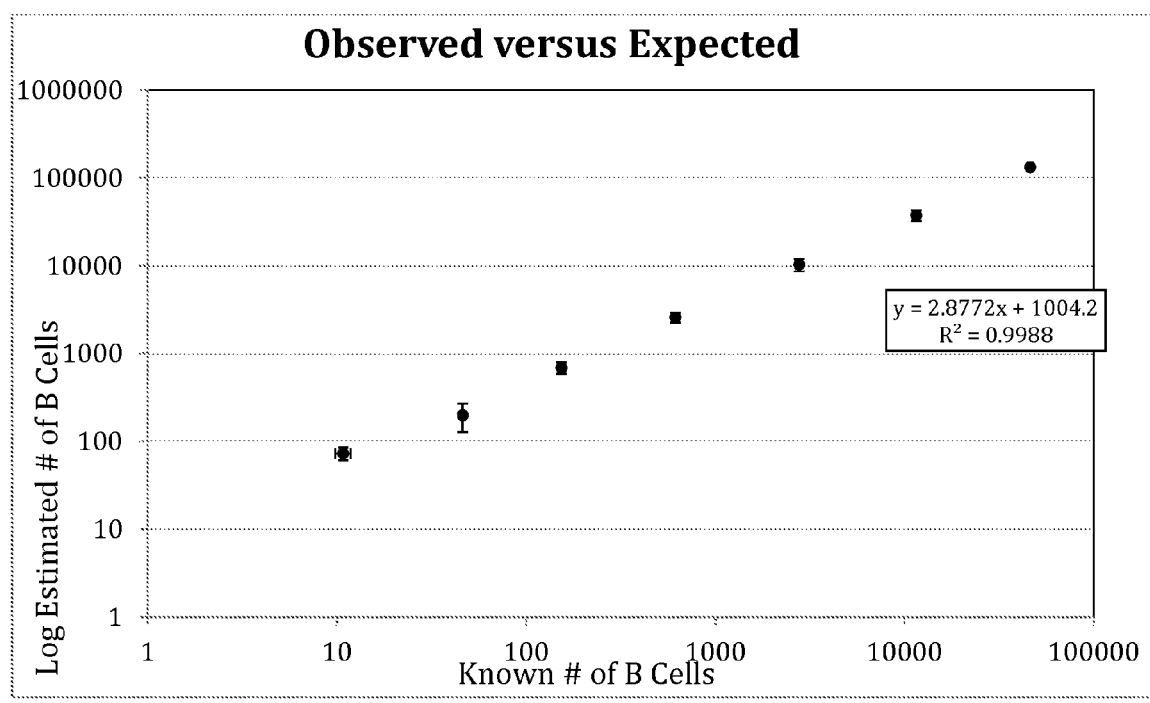

FIG. 8 shows a plot of the numbers of B cells that were estimated by multiplexed PCR using a synthetic template composition and an amplification factor calculated as described herein, versus the known numbers of B cells used as a source of natural DNA templates. Constant amounts of total DNA, of which a varied proportion was DNA from B cells, were added to multiplexed PCR reactions. In addition, approximately 5,000 synthetic template oligonucleotide molecules of general formula (I) (approximately 4-5 molecules of each sequence) were spiked into each reaction. The number of B cell genomes present in the DNA added to each PCR reaction, as estimated by the amplification of the synthetic template oligonucleotide molecules, is represented on the Y axis. On the X axis is shown the actual amount of DNA added to each PCR reaction. The correlation between actual and expected values was $r2=0.9988$.

FIG. 9 (FIG. 9A-9L) shows exemplary TCRB V/J sets (68 V+13 J) for use in template compositions that comprise a plurality of oligonucleotide sequences of general formula 5'-U1-B1-V-B2-R-B3-J-B4-U2-3' [I], for use in determining an amplification factor when amplifying rearranged DNA encoding one or a plurality of human T cell receptor β (TCRB) chain polypeptides.

FIG. 10 (FIG. 10A-10B) shows exemplary TCRG V/J sets (14 V+5 J) for use in template compositions that comprise a plurality of oligonucleotide sequences of general formula 5'-U1-B1-V-B2-R-B3-J-B4-U2-3' [I], for use in determining an amplification factor when amplifying rearranged DNA encoding one or a plurality of human T cell receptor γ (TCRG) chain polypeptides.

FIG. 11 (FIG. 11A-11M) shows exemplary IGH V/J sets (127 V+9 J) for use in template compositions that comprise a plurality of oligonucleotide sequences of general formula 5'-U1-B1-V-B2-R-B3-J-B4-U2-3' [I], for use in determining an amplification factor when amplifying rearranged DNA encoding one or a plurality of human immunoglobulin heavy (IGH) chain polypeptides.

Figure 12:
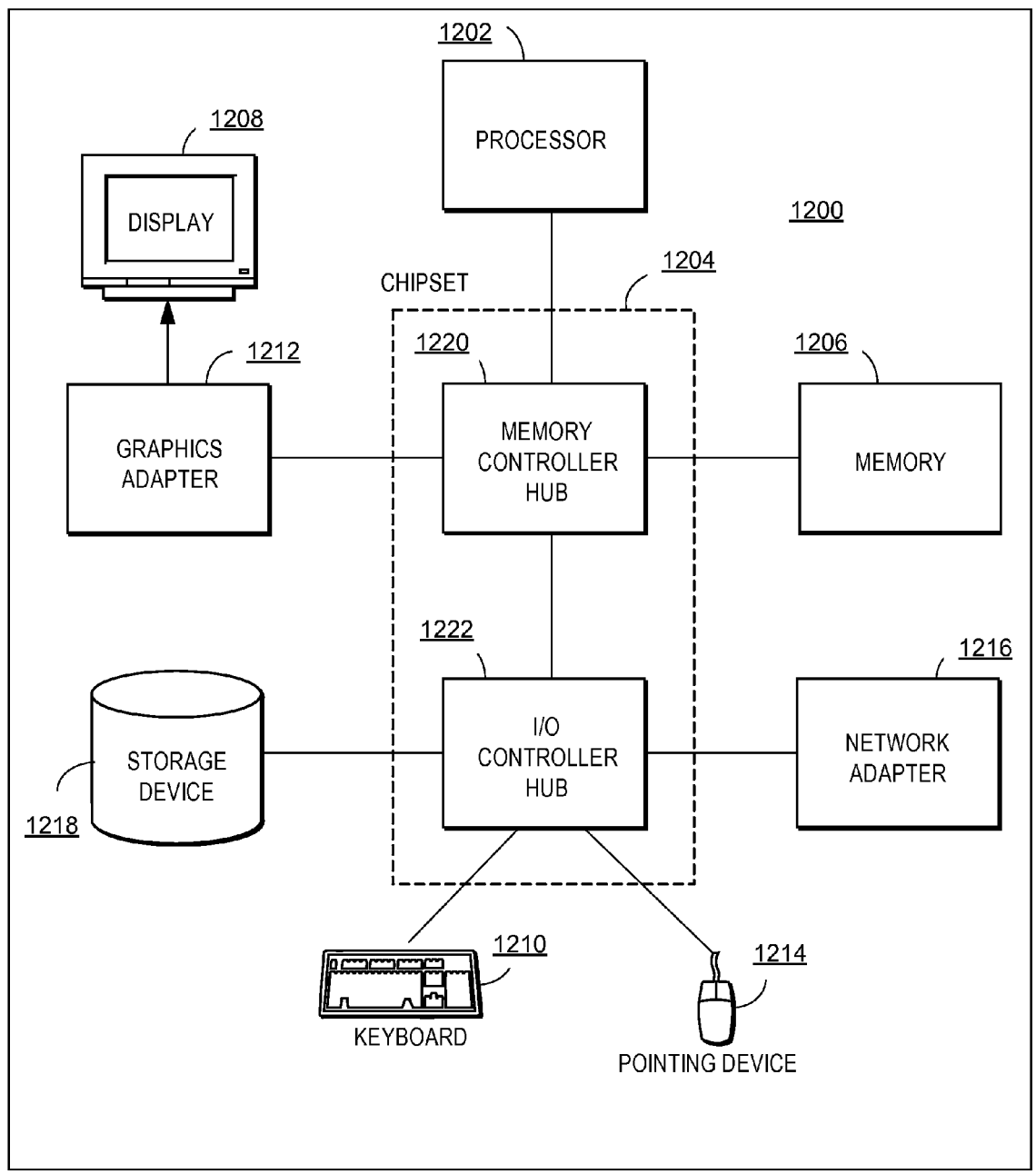

FIG. 12 is a high-level block diagram illustrating a functional view of a typical computer system for use in methods according to certain embodiments of the invention.

BRIEF DESCRIPTION OF THE SEQUENCES

SEQ ID NOS:1-871 are TCRB template oligonucleotide sequences of a template composition for amplification factor determination.

SEQ ID NOS:872-1560 are TCRB template oligonucleotide sequences of a template composition for amplification factor determination.

SEQ ID NOS:1561-1630 are TCRG template oligonucleotide sequences of a template composition for amplification factor determination.

SEQ ID NOS:1631-1695 are oligonucleotide primer sequences for TCRB amplification (TCRB-J, SEQ ID NOS: 1631-1643; TCRB-V, SEQ ID NOS:1644-1695).

SEQ ID NOS:1696-1709 are oligonucleotide primer sequences for DNA sequencing.

SEQ ID NOS:1710-1731 are oligonucleotide adaptor sequences.

SEQ ID NOS:1732-1745 are oligonucleotide primer sequences for TCRG amplification (TCRG-V, SEQ ID NOS: 1732-1741; TCRG-J, SEQ ID NOS:1742-1745).

SEQ ID NOS:1746-1747 are oligonucleotide adaptor sequences.

SEQ ID NO:1748 is an exemplary oligonucleotide barcode sequence.

SEQ ID NO:1749 is an exemplary V polynucleotide sequence.

SEQ ID NO:1750 is an exemplary J polynucleotide sequence.

SEQ ID NOS:1751-1752 are Illumina Nextera™ adaptor oligonucleotide sequences.

SEQ ID NOS:1753-1804 are oligonucleotide primer sequences for TCRB amplification.

SEQ ID NOS:1805-2920 are IGH template oligonucleotide sequences of a template composition for amplification factor determination.

SEQ ID NOS:2921-2988 are TCRB V polynucleotide sequences for use in a template composition for amplification factor determination.

SEQ ID NOS:2989-3001 are TCRB J polynucleotide sequences for use in a template composition for amplification factor determination.

SEQ ID NOS:3002-3015 are TCRG V polynucleotide sequences for use in a template composition for amplification factor determination.

SEQ ID NOS:3016-3020 are TCRG J polynucleotide sequences for use in a template composition for amplification factor determination.

SEQ ID NOS:3021-3147 are IGH V polynucleotide sequences for use in a template composition for amplification factor determination.

SEQ ID NOS:3148-3156 are IGH J polynucleotide sequences for use in a template composition for amplification factor determination.

SEQ ID NOS:3157-4014 are TCRB template oligonucleotide sequences of a template composition for amplification factor determination.

SEQ ID NOS:4015-4084 are TCRG template oligonucleotide sequences of a template composition for amplification factor determination.

SEQ ID NOS:4085-5200 are IGH template oligonucleotide sequences of a template composition for amplification factor determination.

SEQ ID NOS:5201-5286 are oligonucleotide forward primers for IGH amplification.

SEQ ID NOS:5287-5293 are oligonucleotide reverse primers for IGH amplification.

SEQ ID NOS:5294-5386 are oligonucleotide primer sequences for IGH amplification (IGH-V, SEQ ID NOS: 5294-5379; IGH-J, SEQ ID NOS:5380-5386).

SEQ ID NOS:5387-5578 are oligonucleotide sequences for adaptor tailing primers.

SEQ ID NOS:5579-6382 are oligonucleotide primer sequences for amplification of adaptive immune receptor encoding sequences.

SEQ ID NOS:6383-6388 are exemplary oligonucleotide primers for amplifying control ("housekeeping") gene sequences.

DETAILED DESCRIPTION

The present invention provides, in certain embodiments and as described herein, surprisingly advantageous methods for diagnosing diseases or disorders of lymphoid cells (e.g., T lymphocytes and/or B lymphocytes, including cells of any developmental, differentiative or maturational stage of the lymphoid lineage of hematopoietic cells) such as lymphoid hematological malignancies or other lymphoproliferative disorders, and for detecting minimal residual disease (MRD) in subjects following treatment for such conditions. These and related embodiments are directed in pertinent part to the use of recently developed high-throughput sequencing (HTS) methodologies for the qualitative and quantitative characterization of rearranged DNA sequences of genes that encode adaptive immune receptors such as T-cell receptors (TCR) or B-cell immunoglobulins (Ig).

Multiplexed amplification and high throughput sequencing of rearranged TCR and BCR (IG) encoding DNA sequences are described, for example, in Robins et al., 2009 *Blood* 114, 4099; Robins et al., 2010 *Sci. Translat. Med.* 2:47ra64; Robins et al., 2011 *J. Immunol. Meth. doi:* 10.1016/j.jim.2011.09. 001; Sherwood et al. 2011 *Sci. Translat. Med.* 3:90ra61; U.S. application Ser. No. 13/217, 126 (US Pub. No. 2012/0058902), U.S. application Ser. No. 12/794,507 (US Pub. No. 2010/0330571), WO/2010/ 151416, WO/2011/106738 (PCT/US2011/026373), WO2012/027503 (PCT/US2011/049012), U.S. Application No. 61/550,311, and U.S. Application No. 61/569,118; accordingly these disclosures are incorporated by reference and may be adapted for use according to the embodiments described herein.

Certain present embodiments may usefully benefit clinical management in lymphoid disorders such as lymphoid hematological malignancies or other lymphoproliferative disorders, for example, T-cell acute lymphoblastic leukemia/ lymphoma (T-ALL), by facilitating disease diagnosis and/or by permitting the assessment of minimal residual disease in patients following treatment. As described herein, high-throughput sequencing of T-cell receptor gene loci offers significant advantages over the prior state-of-the-art assessment of MRD by nine-color, multi-parametric flow cytometry (mpFC), including by providing easier standardization of test assay methodologies.

For instance, the present methods provide advantages in one or more of sensitivity, specificity, time, cost, reagent preparation, instrumentation set-up and calibration, overcoming unreliability of prior methods due to dependence on subjective operator manipulations, and other factors, when compared either to mpFC or to patient-specific molecular approaches for MRD testing. As described herein in the Examples, the present methods unexpectedly permitted MRD detection with comparable or greater sensitivity than mpFC, as well as surprising detection of MRD in patient samples for which mpFC failed to identify MRD. In addition, the present HTS methodologies identified T-ALL cases exhibiting early thymic precursor (ETP)-like properties. ETP/T-ALL cases described herein lacked a clonal TCRB gene rearrangement at diagnosis, as identified using the herein described methods. In view of the aggressive clinical course of ETP/T-ALL, improved disease management and other unprecedented advantages associated with early classification of ETP/T-ALL are thus provided by certain embodiments that are herein disclosed.

According to certain of the present embodiments, the ability to qualitatively (e.g., by identifying unique sequences of rearranged TCR or Ig CDR3-encoding gene regions in a sample) and quantitatively (e.g., by determining the relative frequency of occurrence of any given unique rearranged TCR or Ig CDR3-encoding DNA sequence as a proportion of the total number of TCR or Ig encoding sequences in the sample) characterize the diversity of adaptive immune receptors provides the means for diagnosing diseases of lymphoid cells (e.g., a lymphoid hematological malignancy), and also provides means for detecting the presence of minimal residual disease (MRD) in a subject during and following treatment.

Illustrative and non-limiting examples of diseases of lymphoid cells for which the presently disclosed invention embodiments may usefully aid in diagnosis and/or MRD detection include lymphoid hematological malignancies such as acute lymphoblastic leukemia (ALL), multiple myeloma, plasmacytoma, macroglobulinemia, chronic lymphocytic leukemia (CLL), other lymphomas and leukemias including Hodgkins and non-Hodgkins lymphoma, cutaneous T-cell lymphoma, mantle cell lymphoma, peripheral T-cell lymphoma, hairy cell leukemia, T prolymphocytic lymphoma, angioimmunoblastic T-cell lymphoma, T lymphoblastic leukemia/lymphoma, peripheral T-cell lymphoma—not otherwise specified, adult T cell leukemia/ lymphoma, mycosis fungoides, Sezary syndrome, T lymphoblastic leukemia and any other cancer involving T cells or B cells; and may also include other lymphoproliferative disorders, including myeloproliferative neoplasms, myelodysplastic syndrome, and others.

The detection of MRD can play a significant role not only in monitoring a patient's response to therapy, but also in the accurate diagnosis of the underlying cause of major clinical signs. MRD typically refers to the presence of malignant cells (usually in reference to leukemic cells) that are not detectable on the basis of cellular morphology. Several studies have shown that quantitative detection of MRD in lymphoid malignancies predicts clinical outcome. (Szczepanski T, et al., *Lancet Oncol* 2001; 2:409-17; van Dongen J J, et al., *Lancet* 1998; 352:1731-8; Bruggemann M, et al., *Acta Haematol* 2004; 112:111-9; Cave H, et al., *N Engl J Med* 1998; 339:591-8; Coustan-Smith E, et al., *Blood* 2000; 96:2691-6; Coustan-Smith E, et al., *Blood* 2002; 100:52-8; Wells D A, et al., *Am J Clin Pathol* 1998; 110:84-94; Radich J, et al., *Biol Blood Marrow Transplant* 1995; 1:24-31; Bahloul M, et al., *Best Pract Res Clin Haematol* 2005; 18:97-111; Hoshino A, et al., *Tohoku J Exp Med.* 2004; 203:155-64; Ciudad J, et al., *Br J Haematol* 1999; 104:695-705; Lucio P, et al., *Leukemia* 1999; 13:419-27.) Certain contemplated embodiments that relate to diagnosis, for example, may include detecting MRD in lymphomas by first performing high throughput sequencing (HTS) as described herein of DNA encoding one or more adaptive immune receptors (e.g., TCR or Ig) in a sample containing lymphoid cells obtained from lymph or lymph nodes, peripheral blood or other tissues, to identify one or more TCR or Ig clonal sequences, and may then further involve tracking the frequency of occurrence of such TCR or Ig clonal sequences in blood samples at one or more subsequent time points.

Monitoring the response of a cancer patient to a therapeutic treatment on the basis of tumor load quantification (e.g., by MRD detection) may assist in the assessment of a relative risk of relapse, and can also be used to identify patients who may benefit from therapy reduction, therapy intensification, reduction of immunosuppression for graft-versus-leukemia effect after a stem cell transplant, or adoptive T cell therapy. (Bradfield S M, et al., *Leukemia* 2004; 18:1156-8.) Minimal disease may also be encountered in diagnostic situations. For example, low levels of monoclonal B cells in patients presenting clinically with cytopenia may raise suspicions for a diagnosis of myelodysplastic syndrome. (Wells et al., *Blood* 2003; 102:394-403.) Minimal disease detection is also encountered in staging of lymphoma, which may involve the detection of low levels of tumor cells against a background of normal cells. The detection of minimal disease as described herein (e.g., as MRD detection in lymphoid cancer patients following treatment) need not be limited to monitoring the effects of treatment, but may also find uses in diagnostic settings where no reference population is available for comparison.

According to certain embodiments there is thus provided a method for detecting minimal residual disease which comprises amplifying DNA extracted from a first sample (e.g., bone marrow, lymph or blood, depending on the type of cancer) obtained from the patient in a multiplex polymerase chain reaction (PCR) using V and J segment primer sets as described herein and in one or more of Robins et al., 2009 *Blood* 114, 4099; Robins et al., 2010 *Sci. Translat. Med.* 2:47ra64; Robins et al., 2011 *J. Immunol. Meth.* doi:10.1016/j.jim.2011.09. 001; Sherwood et al. 2011 *Sci. Translat. Med.* 3:90ra61; U.S. application Ser. No. 13/217, 126 (US Pub. No. 2012/0058902), U.S. application Ser. No. 12/794,507 (US Pub. No. 2010/0330571), WO/2010/151416, WO/2011/106738 (PCT/U52011/026373), WO2012/027503 (PCT/US2011/049012), U.S. Application No. 61/550,311, and U.S. Application No. 61/569,118, wherein the first sample is taken at a first time point before or during a therapeutic treatment, and wherein the first sample comprises a population of T or B cells, wherein the V-segment and J-segment primers permit amplification of substantially all combinations of the functional V and J segments of a rearranged TCR or Ig locus in the multiplex PCR to produce a multiplicity of amplified DNA molecules each comprising a TCR or Ig CDR3-encoding region; measuring a relative frequency of uniquely rearranged TCR CDR3-encoding regions, thereby identifying the uniquely rearranged TCR CDR3-encoding region of one or more malignant T cell clones; amplifying with the V-segment primers and the J-segment primers DNA extracted from a second sample from the patient, in a multiplex polymerase chain reaction (PCR), wherein the second sample is taken at a later time point than the first sample and wherein the second sample comprises a population of T or B cells, measuring the relative frequency of the uniquely rearranged TCR or Ig CDR3-encoding region of the one or more malignant T or B cell clones in the second sample; wherein the presence of the uniquely rearranged TCR or Ig CDR3-encoding region of the one or more malignant T or B cell clones in the second sample indicates the presence of minimal residual disease.

In certain embodiments, the presence of the uniquely rearranged CDR3-encoding region of the one or more malignant clones in the second sample at a relative frequency of greater than $10^{-6}$ TCR CDR3-encoding regions indicates the presence of minimal residual disease. In certain other embodiments the relative frequency may be greater than $9 \times 10^{-6}$, $8 \times 10^{-6}$, $7 \times 10^{-6}$, $6 \times 10^{-6}$, $5 \times 10^{-6}$, $4 \times 10^{-6}$, $3 \times 10^{-6}$, $2 \times 10^{-6}$, or $1 \times 10^{-6}$, $9 \times 10^{-4}$, $8 \times 10^{-4}$, $7 \times 10^{-4}$, $6 \times 10^{-4}$, $5 \times 10^{-4}$, $4 \times 10^{4}$, $3 \times 10^{-4}$, $2 \times 10^{4}$, or $1 \times 10^{-4}$.

The present methods may, additionally or alternatively, be used to diagnose a disorder affecting lymphoid cells such as a lymphoid hematological malignancy, for example a malignant disease associated with specific B or T cell clones, where at least one specific malignant clonotype can be identified in a patient. A clonotype may be detected by the presence in DNA extracted from a sample of at least one rearranged DNA molecule encoding a TCR or Ig CDR3 and having a unique DNA sequence, where the relative frequency of occurrence of the unique rearranged DNA sequence is determined by quantifying adaptive immune receptor diversity according to the methods described herein (including those incorporated by reference).

Preferably and in certain embodiments, detection of at least one unique rearranged CDR3-encoding DNA sequence having a relative frequency of at least 15% of the frequency of occurrence of all detectable rearranged CDR3-encoding sequences for a particular adaptive immune receptor polypeptide (e.g., TCRα, TCRβ, TCRγ, TCRδ, IgVH or IgVL) indicates presence of a malignancy-associated clonotype. In certain other embodiments, detection of at least one unique rearranged CDR3-encoding DNA sequence having a relative frequency of at least 16%, 17%, 18%, 19%, 20%, 21%, 22%, 23%, 24%, 25%, 26%, 27%, 28%, 29% or 30% of the frequency of occurrence of all detectable rearranged CDR3-encoding sequences for a particular adaptive immune receptor polypeptide, indicates presence of a malignancy-associated clonotype.

In certain other embodiments, a clonotype that is diagnostic for a clonal lymphoid hematological malignancy is identified by first determining a standard value $R_c$ (±standard deviation, SD) for the relative frequency of occurrence of the most abundant detectable unique rearranged CDR3-encoding sequence for a particular adaptive immune receptor polypeptide (e.g., TCRα, TCRβ, TCRγ, TCRδ, IgVH or IgVL) in a sample from one or more appropriately matched normal, healthy control subjects. Next, $R_x$ (±SD), the relative frequency of occurrence of detectable rearranged CDR3-encoding sequences for the particular adaptive immune receptor polypeptide in a sample from a subject known to have or suspected of having a lymphoid hematological malignancy, is determined. The sample may be obtained from the subject before, during or after treatment such as therapeutic treatment aimed at the lymphoid malignancy. A clonal lymphoid hematological malignancy may be regarded as being present, according to certain independent embodiments contemplated herein, when Rx is at least 2.5, 3.0, 3.25, 3.5, 3.75, 4.0, 4.25, 4.5, 4.75 or 5.0 standard deviations higher than Rc. For a sample obtained during or after treatment, Rx may thus be used as an indicator of MRD. Accordingly, a malignant clonotype may be identified in these and related embodiments by the presence, at a statistically significant relative level, of a clonotype in the population of uniquely rearranged CDR3-encoding regions that have been amplified and sequenced using the methods herein.

Certain presently disclosed embodiments advantageously permit determination of the number of adaptive immune cells (e.g., T or B lymphocytes) in a sample that contains lymphoid cells and that may also contain non-lymphoid cells, where DNA is extracted from the sample for use as a source of templates for multiplexed DNA amplification according to the present methods. In these and related embodiments, which are described in greater detail elsewhere herein, an artificial template composition for amplification factor determination is included in (or "spiked" in) the multiplexed amplification reaction. Quantitative sequencing of the amplification products of the template composition (which products are identifiable by virtue of unique oligonucleotide barcode sequences contained therein) permits calculation of an amplification factor that is a characteristic of the particular multiplexed amplification reaction (e.g., templates, amplification primers, reaction conditions, etc.) that has been performed. The amplification factor may then be used to calculate, from the quantitative sequencing data, the quantity of unique adaptive immune receptor encoding DNA molecules (e.g., lymphoid cell genomes that contain rearranged adaptive immune receptor encoding DNA) in the sample.

These and related embodiments thus further comprise quantifying rearranged DNA molecules encoding one or a plurality of adaptive immune receptors in DNA extracted from biological samples that comprise DNA from lymphoid cells of a subject as provided herein, by performing the steps of amplifying in the presence of a known quantity of the template composition for amplification factor determination; quantitatively sequencing amplification products of rearranged adaptive immune receptor encoding DNA in the sample and of the template composition; calculating an amplification factor; and dividing the number of amplified rearranged products of the rearranged adaptive immune receptor encoding DNA by the amplification factor to quantify the unique adaptive immune receptor encoding DNA molecules that are present in the sample.

Samples and Subjects

The subject or biological source, from which a test biological sample may be obtained, may be a human or non-human animal, or a transgenic or cloned or tissue-engineered (including through the use of stem cells) organism. In certain preferred embodiments of the invention, the subject or biological source may be known to have, or may be suspected of having or being at risk for having, a lymphoid hematopoietic cancer or other malignant condition, or an autoimmune disease, or an inflammatory condition, and in certain preferred embodiments of the invention the subject or biological source may be known to be free of a risk or presence of such disease.

Certain preferred embodiments contemplate a subject or biological source that is a human subject such as a patient that has been diagnosed as having or being at risk for developing or acquiring cancer according to art-accepted clinical diagnostic criteria, such as those of the U.S. National Cancer Institute (Bethesda, MD., USA) or as described in *DeVita, Hellman, and Rosenberg's Cancer: Principles and Practice of Oncology* (2008, Lippincott, Williams and Wilkins, Philadelphia/Ovid, N.Y.); Pizzo and Poplack, *Principles and Practice of Pediatric Oncology* (Fourth edition, 2001, Lippincott, Williams and Wilkins, Philadelphia/Ovid, N.Y.); Vogelstein and Kinzler, *The Genetic Basis of Human Cancer* (Second edition, 2002, McGraw Hill Professional, New York); Dancey et al. (2009 *Semin. Oncol.* 36 Suppl. 3:S46); certain embodiments contemplate a human subject that is known to be free of a risk for having, developing or acquiring cancer by such criteria.

Certain other embodiments contemplate a non-human subject or biological source, for example a non-human primate such as a macaque, chimpanzee, gorilla, vervet, orangutan, baboon or other non-human primate, including such non-human subjects that may be known to the art as preclinical models, including preclinical models for solid tumors and/or other cancers. Certain other embodiments contemplate a non-human subject that is a mammal, for example, a mouse, rat, rabbit, pig, sheep, horse, bovine, goat, gerbil, hamster, guinea pig or other mammal; many such mammals may be subjects that are known to the art as preclinical models for certain diseases or disorders, including lymphoid hematopoietic malignancies and/or other cancers (e.g., Li et al., 2011 *Dis. Model. Mech.* 4:311; von Euler et al., 2011 *Vet. Comp. Oncol.* 9:1; Goldstein et al., 2010 *Expert Rev. Hematol.* 3:301; Diamond et al., 2009 *J. Bone Min. Res.* 24:1150; Macor et al., 2008 *Curr. Pharm. Des.* 14:2023; Talmadge et al., 2007 *Am. J. Pathol.* 170:793; Kerbel, 2003 *Canc. Biol. Therap.* 2(4 Suppl 1):S134; Man et al., 2007 *Canc. Met. Rev.* 26:737; Cespedes et al., 2006 *Clin. Transl. Oncol.* 8:318). The range of embodiments is not intended to be so limited, however, such that there are also contemplated other embodiments in which the subject or biological source may be a non-mammalian vertebrate, for example, another higher vertebrate, or an avian, amphibian or reptilian species, or another subject or biological source.

As also noted elsewhere herein, art-accepted clinical diagnostic criteria have been established for these and other cancer types, such as those promulgated by the U.S. National Cancer Institute (Bethesda, Md., USA) or as described in *DeVita, Hellman, and Rosenberg's Cancer: Principles and Practice of Oncology* (2008, Lippincott, Williams and Wilkins, Philadelphia/Ovid, N.Y.); Pizzo and Poplack, *Principles and Practice of Pediatric Oncology* (Fourth edition, 2001, Lippincott, Williams and Wilkins, Philadelphia/Ovid, N.Y.); and Vogelstein and Kinzler, *The Genetic Basis of Human Cancer* (Second edition, 2002, McGraw Hill Professional, New York). Other non-limiting examples of typing and characterization of particular cancers are described, e.g., in Ignatiadis et al. (2008 *Pathobiol.* 75:104); Kunz (2008 *Curr. Drug Discov. Technol.* 5:9); and Auman et al. (2008 *Drug Metab. Rev.* 40:303).

Biological samples may be provided by obtaining a blood sample, biopsy specimen, tissue explant, organ culture, biological fluid or any other tissue or cell preparation from a subject or a biological source. B cells and T cells can thus be obtained from a biological sample, such as from a variety of tissue and biological fluid samples including bone marrow, thymus, lymph glands, lymph nodes, peripheral tissues and blood, but peripheral blood is most easily accessed. Any peripheral tissue can be sampled for the presence of B and T cells and is therefore contemplated for use in the methods described herein. Tissues and biological fluids from which adaptive immune cells may be obtained include, but are not limited to skin, epithelial tissues, colon, spleen, a mucosal secretion, oral mucosa, intestinal mucosa, vaginal mucosa or a vaginal secretion, cervical tissue, ganglia, saliva, cerebrospinal fluid (CSF), bone marrow, cord blood, serum, serosal fluid, plasma, lymph, urine, ascites fluid, pleural fluid, pericardial fluid, peritoneal fluid, abdominal fluid, culture medium, conditioned culture medium or lavage fluid. In certain embodiments, adaptive immune cells (e.g., hematopoietic cells of lymphoid lineage such as T cells and B cells) may be isolated from an apheresis sample. Peripheral blood samples may be obtained by phlebotomy from subjects. Peripheral blood mononuclear cells (PBMC) are isolated by techniques known to those of skill in the art, e.g., by Ficoll-Hypaque® density gradient separation. In certain embodiments, whole PBMCs are used for analysis.

In certain related embodiments, preparations that comprise predominantly lymphocytes (e.g., T and B cells) or that comprise predominantly T cells or predominantly B cells, including preparations in which cells of a lymphoid hematological malignancy are present, may be prepared for use as a biological sample as provided herein, according to established, art-accepted methodologies. In other related embodiments, specific subpopulations of T or B cells may be isolated prior to analysis using the methods described herein. Various methods and commercially available kits for isolating different subpopulations of T and B cells are known in the art and include, but are not limited to, subset selection immunomagnetic bead separation or flow immunocytometric cell sorting using antibodies specific for one or more of any of a variety of known T and B cell surface markers. Illustrative markers include, but are not limited to, one or a combination of CD2, CD3, CD4, CD8, CD14, CD19, CD20, CD25, CD28, CD45RO, CD45RA, CD54, CD62, CD62L, CDw137 (41BB), CD154, GITR, FoxP3, CD54, and CD28. For example, and as is known to the skilled person, cell surface markers, such as CD2, CD3, CD4, CD8, CD14, CD19, CD20, CD45RA, and CD45RO may be used to determine T, B, and monocyte lineages and subpopulations in flow cytometry. Similarly, forward light-scatter, side-scatter, and/or cell surface markers such as CD25, CD62L, CD54, CD137, CD154 may be used to determine activation state and functional properties of cells.

Illustrative combinations useful in certain of the methods described herein may include CD8$^+$CD45RO$^+$ (memory cytotoxic T cells), CD4$^+$CD45RO$^+$ (memory T helper), CD8$^+$CD45RO$^-$ (CD8$^+$CD62L$^+$CD45RA$^+$ (naïve-like cytotoxic T cells); CD4$^+$CD25$^+$CD62L$^{hi}$GITR$^+$FoxP3$^+$ (regulatory T cells). Illustrative antibodies for use in immunomagnetic cell separations or flow immunocytometric cell sorting include fluorescently labeled anti-human antibodies, e.g., CD4 FITC (clone M-T466, Miltenyi Biotec), CD8 PE (clone RPA-T8, BD Biosciences), CD45RO ECD (clone UCHL-1, Beckman Coulter), and CD45RO APC (clone UCHL-1, BD Biosciences). Staining of total PBMCs may be done with the appropriate combination of antibodies, followed by washing cells before analysis. Lymphocyte subsets can be isolated by fluorescence activated cell sorting (FACS), e.g., by a BD FACSAria™ cell-sorting system (BD Biosciences) and by analyzing results with FlowJo™ software (Treestar Inc.), and also by conceptually similar methods involving specific antibodies immobilized to surfaces or beads.

For nucleic acid extraction, total genomic DNA may be extracted from cells using methods known in the art and/or commercially available kits, e.g., by using the QIAamp® DNA blood Mini Kit (QIAGEN®). The approximate mass of a single haploid genome is 3 pg. Preferably, at least 25,000 to 250,000 cells, for example, at least 50,000 to 125,000 cells, or at least 75,000 to 150,000 cells, or at least 100,000 to 200,000 cells, are used for analysis, i.e., about 0.15 to 1.5 μg, or for instance, 0.6 to 1.2 μg DNA from diploid T or B cells. The number of T or B cells present in a sample may vary considerably when the sample is obtained from a patient having a lymphoid hematological malignancy such as acute T-cell lymphoblastic leukemia (T-ALL). Using PBMCs from a normal healthy adult human as a source, the number of T cells can be estimated to be about 30% of total cells; the number of B cells can also be estimated to be about 10% of total cells in a PBMC preparation.

Adaptive Immune Cell Receptors

The native TCR is a heterodimeric cell surface protein of the immunoglobulin superfamily which is associated with invariant proteins of the CD3 complex involved in mediating signal transduction. TCRs exist in αβ and γδ forms, which are structurally similar but have quite distinct anatomical locations and probably functions. The MHC class I and class II ligands, which bind to the TCR, are also immunoglobulin superfamily proteins but are specialized for antigen presentation, with a highly polymorphic peptide binding site which enables them to present a diverse array of short peptide fragments at the APC cell surface.

The extracellular portions of native heterodimeric αβ and γδ TCRs consist of two polypeptides each of which has a membrane-proximal constant domain, and a membrane-distal variable domain. Each of the constant and variable domains includes an intra-chain disulfide bond. The variable domains contain the highly polymorphic loops analogous to the complementarity determining regions (CDRs) of antibodies. CDR3 of αβ TCRs interact with the peptide presented by MHC, and CDRs 1 and 2 of αβ TCRs interact with the peptide and the MHC. The diversity of TCR sequences is generated via somatic rearrangement of linked variable (V), diversity (D), joining (J), and constant genes.

The Ig and TCR gene loci contain many different variable (V), diversity (D), and joining (J) gene segments, which are subjected to rearrangement processes during early lymphoid differentiation. Ig and TCR V, D and J gene segment sequences are known in the art and are available in public databases such as GENBANK. Non-limiting examples of TCRB V region gene segment sequences are set forth in the sequence listing at SEQ ID NOS:5579-5630, 5644-5779, 6222-6273 and 6287-6351, and examples of TCRB J region segment sequences are set forth in SEQ ID NOS:5631-5643, 5780-5792 and 6274-6286. Exemplary TCRG J region gene segment sequences are set forth in SEQ ID NOs:5793-5798 and 6212-6215. Exemplary TCRG V region gene segment sequences are set forth in SEQ ID NOs:5799-5816 and 6124-6127. Exemplary IgH J region gene segment sequences are set forth in SEQ ID NOs:5817-5832 and 6216-6221; exemplary IgH V region gene segment sequences are set forth in SEQ ID NOs:5833-6123 and 6128-6211.

The V-D-J rearrangements are mediated via a recombinase enzyme complex in which the RAG1 and RAG2 proteins play a key role by recognizing and cutting the DNA at the recombination signal sequences (RSS), which are located downstream of the V gene segments, at both sides of the D gene segments, and upstream of the J gene segments. Inappropriate RSS reduce or even completely prevent rearrangement. The recombination signal sequence (RSS) consists of two conserved sequences (heptamer, 5'-CACAGTG-3', and nonamer, 5'-ACAAAAACC-3'), separated by a spacer of either 12+/−1 bp ("12-signal") or 23+/−1 bp ("23-signal"). A number of nucleotide positions have been identified as important for recombination including the CA dinucleotide at position one and two of the heptamer, and a C at heptamer position three has also been shown to be strongly preferred as well as an A nucleotide at positions 5, 6, 7 of the nonamer. (Ramsden et. al 1994 *Nucl. Ac. Res.* 22:1785; Akamatsu et. al. 1994 *J. Immunol.* 153:4520; Hesse et. al. 1989 *Genes Dev.* 3:1053). Mutations of other nucleotides have minimal or inconsistent effects. The spacer, although more variable, also has an impact on recombination, and single-nucleotide replacements have been shown to significantly impact recombination efficiency (Fanning et. al. 1996 *Cell. Immunol. Immumnopath.* 79:1, Larijani et. al 1999 *Nucl. Ac. Res.* 27:2304; Nadel et. al. 1998 *J. Immunol.* 161:6068; Nadel et al., 1998 *J. Exp. Med.* 187:1495). Criteria have been described for identifying RSS polynucleotide sequences having significantly different recombination efficiencies (Ramsden et. al 1994 *Nucl. Ac. Res.* 22:1785;

Akamatsu et. al. 1994 *J. Immunol.* 153:4520; Hesse et. al. 1989 *Genes Dev.* 3:1053, and Lee et al., 2003 *PLoS* 1(1):E1).

The rearrangement process generally starts with a D to J rearrangement followed by a V to D-J rearrangement in the case of Ig heavy chain (IgH), TCR beta (TCRB), and TCR delta (TCRD) genes or concerns direct V to J rearrangements in case of Ig kappa (IgK), Ig lambda (IgL), TCR alpha (TCRA), and TCR gamma (TCRG) genes. The sequences between rearranging gene segments are generally deleted in the form of a circular excision product, also called TCR excision circle (TREC) or B cell receptor excision circle (BREC).

The many different combinations of V, D, and J gene segments represent the so-called combinatorial repertoire, which is estimated to be ~$2 \times 10^6$ for Ig molecules, ~$3 \times 10^6$ for TCRO and ~$5 \times 10^3$ for TCRγδ molecules. At the junction sites of the V, D, and J gene segments, deletion and random insertion of nucleotides occurs during the rearrangement process, resulting in highly diverse junctional regions, which significantly contribute to the total repertoire of Ig and TCR molecules, estimated to be >$10^{12}$.

Mature B-lymphocytes further extend their Ig repertoire upon antigen recognition in follicle centers via somatic hypermutation, a process, leading to affinity maturation of the Ig molecules. The somatic hypermutation process focuses on the V- (D-) J exon of IgH and Ig light chain genes and concerns single nucleotide mutations and sometimes also insertions or deletions of nucleotides. Somatically-mutated Ig genes are also found in mature B-cell malignancies of follicular or post-follicular origin.

In certain preferred embodiments described herein, V-segment and J-segment primers may be employed in a PCR reaction to amplify rearranged TCR or Ig CDR3-encoding DNA regions in a test biological sample, wherein each functional TCR or Ig V-encoding gene segment comprises a V gene recombination signal sequence (RSS) and each functional TCR or Ig J-encoding gene segment comprises a J gene RSS. In these and related embodiments, each amplified rearranged DNA molecule may comprise (i) at least about 10, 20, 30 or 40 contiguous nucleotides of a sense strand of the TCR or Ig V-encoding gene segment, with the at least about 10, 20, 30 or 40 contiguous nucleotides being situated 5' to the V gene RSS and/or each amplified rearranged DNA molecule may comprise (ii) at least about 10, 20 or 30 contiguous nucleotides of a sense strand of the TCR or Ig J-encoding gene segment, with the at least about 10, 20 or 30 contiguous nucleotides being situated 3' to the J gene RSS. In certain preferred embodiments, each amplified TCR or Ig CDR3-encoding region is present in an amplified rearranged DNA molecule that is less than 600 nucleotides in length. Without wishing to be bound by theory, these design features for amplifying CDR3-encoding V-J junctional regions permit V-segment primer hybridization to substantially all functional TCR or Ig V-encoding gene segments, and also permit J-segment primer hybridization to substantially all functional TCR or Ig J-encoding segments, and also permit amplification of CDR3-encoding regions that are amenable to sequencing by the herein described HTS platforms while including adequate sequence information to identify all possible V-D-J and V-J combinations.

Multiplex Quantitative PCR

As described herein and in view of Robins et al., 2009 *Blood* 114, 4099; Robins et al., 2010 *Sci. Translat. Med.* 2:47ra64; Robins et al., 2011 *J. Immunol. Meth.* doi: 10.1016/j.jim.2011.09. 001; Sherwood et al. 2011 *Sci. Translat. Med.* 3:90ra61; U.S. application Ser. No. 13/217, 126 (US Pub. No. 2012/0058902), U.S. application Ser. No. 12/794,507 (US Pub. No. 2010/0330571), WO/2010/151416, WO/2011/106738 (PCT/US2011/026373), WO2012/027503 (PCT/US2011/049012), U.S. Application No. 61/550,311, and U.S. Application No. 61/569,118, there is provided a method for quantifying the relative representation of adaptive immune cell DNA in DNA from a test biological sample, and thus for determining the relative frequency of occurrence for each unique rearranged TCR or Ig encoding DNA sequence in a sample that contains lymphoid cells. According to certain preferred embodiments the method involves a multiplex PCR method using a set of forward primers that specifically hybridize to the V segments and a set of reverse primers that specifically hybridize to the J segments where the multiplex PCR reaction allows amplification of all the possible VJ (and VDJ) combinations within a given population of T or B cells.

DNA or RNA may be extracted from cells in a sample, such as a sample of blood or lymph or other sample from a subject known to have or suspected of having a lymphoid hematological malignancy, using standard methods or commercially available kits known in the art. A multiplex PCR system may be used to amplify rearranged adaptive immune cell receptor loci from genomic DNA, preferably from a CDR3 region. In certain embodiments, the CDR3 region is amplified from a TCRα, TCRβ, TCRγ or TCRδ CDR3 region or similarly from an IgH or IgL (lambda or kappa) locus. Compositions are provided that comprise a plurality of V-segment and J-segment primers that are capable of promoting amplification in a multiplex polymerase chain reaction (PCR) of substantially all productively rearranged adaptive immune receptor CDR3-encoding regions in the sample for a given class of such receptors (e.g., TCRγ, TCRβ, IgH, etc.), to produce a multiplicity of amplified rearranged DNA molecules from a population of T cells (for TCR) or B cells (for Ig) in the sample. Preferably and in certain embodiments, primers are designed so that each amplified rearranged DNA molecule in the multiplicity of amplified rearranged DNA molecules is less than 600 nucleotides in length, thereby excluding amplification products from non-rearranged adaptive immune receptor loci.

In the human genome there are currently believed to be about 70 TCR Vα and about 61 Jα gene segments, about 52 TCR Vβ, about 2 Dβ and about 13 Jβ gene segments, about 9 TCR Vγ and about 5 Jγ gene segments, and about 46 immunoglobulin heavy chain (IGH) $V_H$, about 23 $D_H$ and about 6 $J_H$ gene segments. Accordingly, where genomic sequences for these loci are known such that specific molecular probes for each of them can be readily produced, it is believed according to non-limiting theory that the present compositions and methods relate to substantially all (e.g., greater than 90%, 91%, 92%, 93%, 94%, 95%, 96%, 97%, 98% or 99%) of these known and readily detectable adaptive immune receptor V-, D- and J-region encoding gene segments.

The TCR and Ig genes can generate millions of distinct proteins via somatic mutation. Because of this diversity-generating mechanism, the hypervariable complementarity determining regions (CDRs) of these genes can encode sequences that can interact with millions of ligands, and these regions are linked to a constant region that can transmit a signal to the cell indicating binding of the protein's cognate ligand. The adaptive immune system employs several strategies to generate a repertoire of T- and B-cell antigen receptors with sufficient diversity to recognize the universe of potential pathogens. In αβ and γδ T cells, which primarily recognize peptide antigens presented by MHC molecules, most of this receptor diversity is contained within the third complementarity-determining region (CDR3) of the T cell receptor (TCR) α and β chains (or γ and δ chains).

The assay technology uses two pools of primers to provide for a highly multiplexed PCR reaction. The first, "forward" pool (e.g., by way of illustration and not limitation, V-segment oligonucleotide primers described herein may in certain preferred embodiments be used as "forward" primers when J-segment oligonucleotide primers are used as "reverse" primers according to commonly used PCR terminology, but the skilled person will appreciate that in certain other embodiments J-segment primers may be regarded as "forward" primers when used with V-segment "reverse" primers) includes an oligonucleotide primer that is specific to (e.g., having a nucleotide sequence complementary to a unique sequence region of) each V-region encoding segment ("V segment) in the respective TCR or Ig gene locus. In certain embodiments, primers targeting a highly conserved region are used, to simultaneously capture many V segments, thereby reducing the number of primers required in the multiplex PCR. Similarly, in certain embodiments, the "reverse" pool primers anneal to a conserved sequence in the joining ("J") segment.

Each primer may be designed so that a respective amplified DNA segment is obtained that includes a sequence portion of sufficient length to identify each J segment unambiguously based on sequence differences amongst known J-region encoding gene segments in the human genome database, and also to include a sequence portion to which a J-segment-specific primer may anneal for resequencing. This design of V- and J-segment-specific primers enables direct observation of a large fraction of the somatic rearrangements present in the adaptive immune receptor gene repertoire within an individual. This feature in turn enables rapid comparison of the TCR and/or Ig repertoires (i) in individuals having a particular disease, disorder, condition or other indication of interest (e.g., cancer, an autoimmune disease, an inflammatory disorder or other condition) with (ii) the TCR and/or Ig repertoires of control subjects who are free of such diseases, disorders conditions or indications.

The term "gene" means the segment of DNA involved in producing a polypeptide chain such as all or a portion of a TCR or Ig polypeptide (e.g., a CDR3-containing polypeptide); it includes regions preceding and following the coding region "leader and trailer" as well as intervening sequences (introns) between individual coding segments (exons), and may also include regulatory elements (e.g., promoters, enhancers, repressor binding sites and the like), and may also include recombination signal sequences (RSSs) as described herein.

The nucleic acids of the present embodiments, also referred to herein as polynucleotides, and including oligonucleotides, may be in the form of RNA or in the form of DNA, which DNA includes cDNA, genomic DNA, and synthetic DNA. The DNA may be double-stranded or single-stranded, and if single stranded may be the coding strand or non-coding (anti-sense) strand. A coding sequence which encodes a TCR or an immunoglobulin or a region thereof (e.g., a V region, a D segment, a J region, a C region, etc.) for use according to the present embodiments may be identical to the coding sequence known in the art for any given TCR or immunoglobulin gene regions or polypeptide domains (e.g., V-region domains, CDR3 domains, etc.), or may be a different coding sequence, which, as a result of the redundancy or degeneracy of the genetic code, encodes the same TCR or immunoglobulin region or polypeptide.

In one embodiment, the present disclosure provides a plurality of V segment primers and a plurality of J segment primers, wherein the plurality of V segment primers and the plurality of J segment primers amplify substantially all combinations of the V and J segments of a rearranged immune receptor locus. By substantially all combinations is meant at least 95%, 96%, 97%, 98%, 99% or more of all the combinations of the V and J segments of a rearranged immune receptor locus. In certain embodiments, the plurality of V segment primers and the plurality of J segment primers amplify all of the combinations of the V and J segments of a rearranged immune receptor locus.

In general, a multiplex PCR system may use at least 8, 9, 10, 11, 12, 13, 14, 15, 16, 17, 18, 19, 20, 21, 22, 23, 24, or 25, and in certain embodiments, at least 26, 27, 28, 29, 30, 31, 32, 33, 34, 35, 36, 37, 38, or 39, and in other embodiments 40, 41, 42, 43, 44, 45, 46, 47, 48, 49, 50, 51, 52, 53, 54, 55, 56, 57, 58, 59, 60, 65, 70, 75, 80, 85, or more forward primers, in which each forward primer specifically hybridizes to or is complementary to a sequence corresponding to one or more V region segments. Illustrative V region primers for amplification of the TCRβ are shown in SEQ ID NOs: 5579-5630. Illustrative TCRγ V region primers are provided in SEQ ID NOs:6124-6127. Illustrative IgH V region primers are provided in SEQ ID NOs:6128-6211. V region gene segment sequences may thus be used to design V region primers. Exemplary TCRB V region gene segment sequences are set forth in the sequence listing at SEQ ID NOS:5579-5630, 5644-5779, 6222-6273 and 6287-6351. Exemplary TCRG V region gene segment sequences are set forth in SEQ ID NOs:5799-5816 and 6124-6127. Exemplary IgH V region gene segment sequences are set forth in SEQ ID NOs:5833-6123 and 6128-6211. In SEQ ID NOS: 5579-5643, in the RN2 oligonucleotides "r" represents a ribonucleotide base in the oligonucleotide sequence and "/3SpC3/" represents a 3' three-carbon spacer on the hydroxyl group, preventing polymerase extension and amplification. The DNA repair endonuclease cleaves the oligonucleotide at the ribonucleotide after hybridization to a complementary sequence, creating an unblocked hydroxyl group that can be extended by a polymerase.

The multiplex PCR system also uses at least 3, 4, 5, 6, or 7, and in certain embodiments, 8, 9, 10, 11, 12 or 13 reverse primers, in which each reverse primer specifically hybridizes to or is complementary to a sequence corresponding to one or more J region segments. Illustrative TCRβ J segment primers are provided in SEQ ID NOs:5631-5643. Illustrative TCRγ J segment primers are provided in SEQ ID NOs:6212-6215. Illustrative IgH J segment primers are provided in SEQ ID NOs:6216-6221. J region gene segment sequences may thus be used to design J region primers. Exemplary TCRB J region segment sequences are set forth in SEQ ID NOS:5631-5643, 5780-5792 and 6274-6286. Exemplary TCRG J region gene segment sequences are set forth in SEQ ID NOs:5793-5798 and 6212-6215. Exemplary IgH J region gene segment sequences are set forth in SEQ ID NOs:5817-5832 and 6216-6221. In one embodiment, there is a J segment primer for every J segment.

Oligonucleotides or polynucleotides that are capable of specifically hybridizing or annealing to a target nucleic acid sequence by nucleotide base complementarity may do so under moderate to high stringency conditions. For purposes of illustration, suitable moderate to high stringency conditions for specific PCR amplification of a target nucleic acid sequence would be between 25 and 80 PCR cycles, with each cycle consisting of a denaturation step (e.g., about 10-30 seconds (s) at greater than about 95° C.), an annealing step (e.g., about 10-30 s at about 60-68° C.), and an extension step (e.g., about 10-60 s at about 60-72° C.), optionally according to certain embodiments with the annealing and extension steps being combined to provide a two-step PCR. As would be recognized by the skilled person, other PCR reagents may be added or changed in the PCR reaction to increase specificity of primer annealing and amplification, such as altering the magnesium concentration, optionally adding DMSO, and/or the use of blocked primers, modified nucleotides, peptide-nucleic acids, and the like.

In certain embodiments, nucleic acid hybridization techniques may be used to assess hybridization specificity of the primers described herein. Hybridization techniques are well known in the art of molecular biology. For purposes of illustration, suitable moderately stringent conditions for testing the hybridization of a polynucleotide as provided herein with other polynucleotides include prewashing in a solution of 5×SSC, 0.5% SDS, 1.0 mM EDTA (pH 8.0); hybridizing at 50° C.-60° C., 5×SSC, overnight; followed by washing twice at 65° C. for 20 minutes with each of 2×, 0.5× and 0.2×SSC containing 0.1% SDS. One skilled in the art will understand that the stringency of hybridization can be readily manipulated, such as by altering the salt content of the hybridization solution and/or the temperature at which the hybridization is performed. For example, in another embodiment, suitable highly stringent hybridization conditions include those described above, with the exception that the temperature of hybridization is increased, e.g., to 60° C.-65° C. or 65° C.-70° C.

PRIMERS. According to the present disclosure, oligonucleotide primers are provided in an oligonucleotide primer set that comprises a plurality of V-segment primers and a plurality of J-segment primers, where the primer set is capable of amplifying rearranged DNA encoding adaptive immune receptors in a biological sample that comprises lymphoid cell DNA. Suitable primer sets are known in the art and disclosed herein, for example, the primer sets in U.S. application Ser. No. 13/217,126; U.S. application Ser. No. 12/794,507; PCT/US2011/026373; or PCT/US2011/049012; or the like; or those shown in Table 1. In certain embodiments the primer set is designed to include a plurality of V sequence-specific primers that includes, for each unique V region gene (including pseudogenes) in a sample, at least one primer that can specifically anneal to a unique V region sequence; and for each unique J region gene in the sample, at least one primer that can specifically anneal to a unique J region sequence.

Primer design may be achieved by routine methodologies in view of known TCR and BCR genomic sequences. Accordingly, the primer set is preferably capable of amplifying every possible V-J combination that may result from DNA rearrangements in the TCR or BCR locus. As also described below, certain embodiments contemplate primer sets in which one or more V primers may be capable of specifically annealing to a "unique" sequence that may be shared by two or more V regions but that is not common to all V regions, and/or in which in which one or more J primers may be capable of specifically annealing to a "unique" sequence that may be shared by two or more J regions but that is not common to all J regions.

In particular embodiments, oligonucleotide primers for use in the compositions and methods described herein may comprise or consist of a nucleic acid of at least about 15 nucleotides long that has the same sequence as, or is complementary to, a 15 nucleotide long contiguous sequence of the target V- or J-segment (i.e., portion of genomic polynucleotide encoding a V-region or J-region polypeptide). Longer primers, e.g., those of about 16, 17, 18, 19, 20, 21, 22, 23, 24, 25, 26, 27, 28, 29, 30, 31, 32, 33, 34, 35, 36, 37, 38, 39, 40, 45, or 50, nucleotides long that have the same sequence as, or sequence complementary to, a contiguous sequence of the target V- or J-region encoding polynucleotide segment, will also be of use in certain embodiments. All intermediate lengths of the presently described oligonucleotide primers are contemplated for use herein. As would be recognized by the skilled person, the primers may have additional sequence added (e.g., nucleotides that may not be the same as or complementary to the target V- or J-region encoding polynucleotide segment), such as restriction enzyme recognition sites, adaptor sequences for sequencing, bar code sequences, and the like (see e.g., primer sequences provided in the Tables and sequence listing herein). Therefore, the length of the primers may be longer, such as about 55, 56, 57, 58, 59, 60, 61, 62, 63, 64, 65, 66, 67, 68, 69, 70, 71, 72, 73, 74, 75, 80, 85, 90, 95, 100 or more nucleotides in length or more, depending on the specific use or need.

Also contemplated for use in certain embodiments are adaptive immune receptor V-segment or J-segment oligonucleotide primer variants that may share a high degree of sequence identity to the oligonucleotide primers for which nucleotide sequences are presented herein, including those set forth in the Sequence Listing. Thus, in these and related embodiments, adaptive immune receptor V-segment or J-segment oligonucleotide primer variants may have substantial identity to the adaptive immune receptor V-segment or J-segment oligonucleotide primer sequences disclosed herein, for example, such oligonucleotide primer variants may comprise at least 70% sequence identity, preferably at least 75%, 80%, 85%, 90%, 91%, 92%, 93%, 94%, 95%, 96%, 97%, 98%, or 99% or higher sequence identity compared to a reference polynucleotide sequence such as the oligonucleotide primer sequences disclosed herein, using the methods described herein (e.g., BLAST analysis using standard parameters). One skilled in this art will recognize that these values can be appropriately adjusted to determine corresponding ability of an oligonucleotide primer variant to anneal to an adaptive immune receptor segment-encoding polynucleotide by taking into account codon degeneracy, reading frame positioning and the like.

Typically, oligonucleotide primer variants will contain one or more substitutions, additions, deletions and/or insertions, preferably such that the annealing ability of the variant oligonucleotide is not substantially diminished relative to that of an adaptive immune receptor V-segment or J-segment oligonucleotide primer sequence that is specifically set forth herein.

Table 1 presents as a non-limiting example an oligonucleotide primer set that is capable of amplifying productively rearranged DNA encoding TCR β-chains (TCRB) in a biological sample that comprises DNA from lymphoid cells of a subject. In this primer set the J segment primers share substantial sequence homology, and therefore may cross-prime amongst more than one target J polynucleotide sequence, but the V segment primers are designed to anneal specifically to target sequences within the CDR2 region of V and are therefore unique to each V segment. An exception, however, is present in the case of several V primers where the within-family sequences of the closely related target genes are identical (e.g., V6-2 and V6-3 are identical at the nucleotide level throughout the coding sequence of the V segment, and therefore may have a single primer, TRB2V6-2/3).

It will therefore be appreciated that in certain embodiments the number of different template oligonucleotides in the template composition, and/or the number of different oligonucleotide primers in the primer set, may be advantageously reduced by designing template and/or primers to exploit certain known similarities in V and/or J sequences. Thus, in these and related embodiments, "unique" oligonucleotide sequences as described herein may include specific V polynucleotide sequences that are shared by 1, 2, 3, 4, 5, 6, 7, 8, 9, 10, 11, 12, 13, 14, 15, 16, 17, 18, 19 or 20 distinct template oligonucleotides and/or specific J polynucleotide sequences that are shared by 1, 2, 3, 4, 5, 6, 7, 8, 9, 10, 11, 12 or 13 distinct template oligonucleotides, where such templates differ in sequence from one another by other than the shared V and/or J sequences.

According to certain presently contemplated embodiments, it may be useful to decrease (e.g., reduce in a statistically significant manner) template amplification bias such as non-uniform nucleic acid amplification potential among members of a set of amplification primers that can result from unequal primer efficiencies (e.g., unequal primer utilization) only for a limited subset of all naturally occurring V and J genes. For example, in analyses of the TCR or BCR immune repertoire involved in an immune response, whether to a specific antigen, as in a vaccine, or to a tissue, as in an autoimmune disease, only the productive TCR or IG rearrangements may be of interest. In such circumstances, it may be economically advantageous to identify and correct non-uniform nucleic acid amplification potential only for those V and J segment primers that contribute to productive rearrangements of TCR or BCR encoding DNA, and to exclude efforts to correct non-uniform amplification of pseudogenes and orphons (i.e., TCR or BCR V region-encoding segments that have been duplicated onto other chromosomes).

In the human IGH locus, for instance, the ImmunoGeneTics (IMGT) database (M.-P. LeFranc, Université Montpellier, Montpellier, France; www.imgt.org) annotates 165 V segment genes, of which 26 are orphons on other chromosomes and 139 are in the IGH locus at chromosome 14. Among the 139 V segments within the IGH locus, 51 have at least one functional allele, while 6 are ORFs (open-reading frames) which are missing at least one highly conserved amino-acid residue, and 81 are pseudogenes. Pseudogenes may include V segments that contain an in-frame stop codon within the V-segment coding sequence, a frameshift between the start codon and the CDR3 encoding sequence, one or more repeat-element insertions, and deletions of critical regions, such as the first exon or the RSS. To characterize functional IGH rearrangements in a sample while avoiding the time and expense of characterizing pseudogenes and/or orphons, it is therefore contemplated to use a subset of the herein described synthetic template oligonucleotides which is designed to include only those V segments that participate in a functional rearrangement to encode a TCR or BCR, without having to synthesize or calibrate amplification primers and template oligonucleotides specific to the pseudogene sequences. Advantageous efficiencies with respect, inter alia, to time and expense are thus obtained.

TABLE 1

Exemplary Oligonucleotide Primer Set (hsTCRB PCR Primers)

| Name | Sequence | SEQ ID NO: |
|---|---|---|
| TRBJ1-1 | TTACCTACAACTGTGAGTCTGGTGCCTTGTCCAAA | 1631 |
| TRBJ1-2 | ACCTACAACGGTTAACCTGGTCCCCGAACCGAA | 1632 |
| TRBJ1-3 | ACCTACAACAGTGAGCCAACTTCCCTCTCCAAA | 1633 |
| TRBJ1-4 | CCAAGACAGAGAGCTGGGTTCCACTGCCAAA | 1634 |
| TRBJ1-5 | ACCTAGGATGGAGAGTCGAGTCCCATCACCAAA | 1635 |
| TRBJ1-6 | CTGTCACAGTGAGCCTGGTCCCGTTCCCAAA | 1636 |
| TRBJ2-1 | CGGTGAGCCGTGTCCCTGGCCCGAA | 1637 |
| TRBJ2-2 | CCAGTACGGTCAGCCTAGAGCCTTCTCCAAA | 1638 |
| TRBJ2-3 | ACTGTCAGCCGGGTGCCTGGGCCAAA | 1639 |
| TRBJ2-4 | AGAGCCGGGTCCCGGCGCCGAA | 1640 |
| TRBJ2-5 | GGAGCCGCGTGCCTGGCCCGAA | 1641 |
| TRBJ2-6 | GTCAGCCTGCTGCCGGCCCCGAA | 1642 |
| TRBJ2-7 | GTGAGCCTGGTGCCCGGCCCGAA | 1643 |
| TRB2V10-1 | AACAAAGGAGAAGTCTCAGATGGCTACAG | 1644 |
| TRB2V10-2 | GATAAAGGAGAAGTCCCCGATGGCTATGT | 1645 |
| TRB2V10-3 | GACAAAGGAGAAGTCTCAGATGGCTATAG | 1646 |
| TRB2V6-2/3 | GCCAAAGGAGAGGTCCCTGATGGCTACAA | 1647 |
| TRB2V6-8 | CTCTAGATTAAACACAGAGGATTTCCCAC | 1648 |
| TRB2V6-9 | AAGGAGAAGTCCCCGATGGCTACAATGTA | 1649 |
| TRB2V6-5 | AAGGAGAAGTCCCCAATGGCTACAATGTC | 1650 |
| TRB2V6-6 | GACAAAGGAGAAGTCCCGAATGGCTACAAC | 1651 |
| TRB2V6-7 | GTTCCCAATGGCTACAATGTCTCCAGATC | 1652 |
| TRB2V6-1 | GTCCCCAATGGCTACAATGTCTCCAGATT | 1653 |
| TRB2V6-4 | GTCCCTGATGGTTATAGTGTCTCCAGAGC | 1654 |
| TRB2V24-1 | ATCTCTGATGGATACAGTGTCTCTCGACA | 1655 |
| TRB2V25-1 | TTTCCTCTGAGTCAACAGTCTCCAGAATA | 1656 |
| TRB2V27 | TCCTGAAGGGTACAAAGTCTCTCGAAAAG | 1657 |
| TRB2V26 | CTCTGAGAGGTATCATGTTTCTTGAAATA | 1658 |
| TRB2V28 | TCCTGAGGGGTACAGTGTCTCTAGAGAGA | 1659 |
| TRB2V19 | TATAGCTGAAGGGTACAGCGTCTCTCGGG | 1660 |
| TRB2V4-1 | CTGAATGCCCCAACAGCTCTCTCTTAAAC | 1661 |
| TRB2V4-2/3 | CTGAATGCCCCAACAGCTCTCACTTATTC | 1662 |
| TRB2V2P | CCTGAATGCCCTGACAGCTCTCGCTTATA | 1663 |
| TRB2V3-1 | CCTAAATCTCCAGACAAAGCTCACTTAAA | 1664 |
| TRB2V3-2 | CTCACCTGACTCTCCAGACAAAGCTCAT | 1665 |
| TRB2V16 | TTCAGCTAAGTGCCTCCCAAATTCACCCT | 1666 |
| TRB2V23-1 | GATTCTCATCTCAATGCCCCAAGAACGC | 1667 |

TABLE 1-continued

Exemplary Oligonucleotide Primer Set
(hsTCRB PCR Primers)

| Name | Sequence | SEQ ID NO: |
|---|---|---|
| TRB2V18 | ATTTTCTGCTGAATTTCCCAAAGAGGGCC | 1668 |
| TRB2V17 | ATTCACAGCTGAAAGACCTAACGGAACGT | 1669 |
| TRB2V14 | TCTTAGCTGAAAGGACTGGAGGGACGTAT | 1670 |
| TRB2V2 | TTCGATGATCAATTCTCAGTTGAAAGGCC | 1671 |
| TRB2V12-1 | TTGATTCTCAGCACAGATGCCTGATGT | 1672 |
| TRB2V12-2 | GCGATTCTCAGCTGAGAGGCCTGATGG | 1673 |
| TRB2V12-3/4 | TCGATTCTCAGCTAAGATGCCTAATGC | 1674 |
| TRB2V12-5 | TTCTCAGCAGAGATGCCTGATGCAACTTTA | 1675 |
| TRB2V7-9 | GGTTCTCTGCAGAGAGGCCTAAGGGATCT | 1676 |
| TRB2V7-8 | GCTGCCCAGTGATCGCTTCTTTGCAGAAA | 1677 |
| TRB2V7-4 | GGCGGCCCAGTGGTCGGTTCTCTGCAGAG | 1678 |
| TRB2V7-6/7 | ATGATCGGTTCTCTGCAGAGAGGCCTGAGG | 1679 |
| TRB2V7-2 | AGTGATCGCTTCTCTGCAGAGAGGACTGG | 1680 |
| TRB2V7-3 | GGCTGCCCAACGATCGGTTCTTTGCAGT | 1681 |
| TRB2V7-1 | TCCCCGTGATCGGTTCTCTGCACAGAGGT | 1682 |
| TRB2V11-123 | CTAAGGATCGATTTTCTGCAGAGAGGCTC | 1683 |
| TRB2V13 | CTGATCGATTCTCAGCTCAACAGTTCAGT | 1684 |
| TRB2V5-1 | TGGTCGATTCTCAGGGCGCCAGTTCTCTA | 1685 |
| TRB2V5-3 | TAATCGATTCTCAGGGCGCCAGTTCCATG | 1686 |
| TRB2V5-4 | TCCTAGATTCTCAGGTCTCCAGTTCCCTA | 1687 |
| TRB2V5-8 | GGAAACTTCCCTCCTAGATTTTCAGGTCG | 1688 |
| TRB2V5-5 | AAGAGGAAACTTCCCTGATCGATTCTCAGC | 1689 |
| TRB2V5-6 | GGCAACTTCCCTGATCGATTCTCAGGTCA | 1690 |
| TRB2V9 | GTTCCCTGACTTGCACTCTGAACTAAAC | 1691 |
| TRB2V15 | GCCGAACACTTCTTTCTGCTTTCTTGAC | 1692 |
| TRB2V30 | GACCCCAGGACCGGCAGTTCATCCTGAGT | 1693 |
| TRB2V20-1 | ATGCAAGCCTGACCTTGTCCACTCTGACA | 1694 |
| TRB2V29-1 | CATCAGCCGCCCAAACCTAACATTCTCAA | 1695 |

In certain preferred embodiments, the V-segment and J-segment oligonucleotide primers as described herein are designed to include nucleotide sequences such that adequate information is present within the sequence of an amplification product of a rearranged adaptive immune receptor (TCR or Ig) gene to identify uniquely both the specific V and the specific J genes that give rise to the amplification product in the rearranged adaptive immune receptor locus (e.g., at least 1, 2, 3, 4, 5, 6, 7, 8, 9, 10, 11, 12, 13, 14, 15, 16, 17, 18, 19 or 20 base pairs of sequence upstream of the V gene recombination signal sequence (RSS), preferably at least about 22, 24, 26, 28, 30, 32, 34, 35, 36, 37, 38, 39 or 40 base pairs of sequence upstream of the V gene recombination signal sequence (RSS), and in certain preferred embodiments greater than 40 base pairs of sequence upstream of the V gene recombination signal sequence (RSS), and at least 1, 2, 3, 4, 5, 6, 7, 8, 9, 10, 11, 12, 13, 14, 15, 16, 17, 18, 19 or 20 base pairs downstream of the J gene RSS, preferably at least about 22, 24, 26, 28 or 30 base pairs downstream of the J gene RSS, and in certain preferred embodiments greater than 30 base pairs downstream of the J gene RSS).

This feature stands in contrast to oligonucleotide primers described in the art for amplification of TCR-encoding or Ig-encoding gene sequences, which rely primarily on the amplification reaction merely for detection of presence or absence of products of appropriate sizes for V and J segments (e.g., the presence in PCR reaction products of an amplicon of a particular size indicates presence of a V or J segment but fails to provide the sequence of the amplified PCR product and hence fails to confirm its identity, such as the common practice of spectratyping).

In certain embodiments, the primers are designed not to cross an intron/exon boundary. The forward primers in certain embodiments anneal to the V segments in a region of relatively strong sequence conservation between V segments so as to maximize the conservation of sequence among these primers. Accordingly, this minimizes the potential for differential annealing properties of each primer, and so that the amplified region between V and J primers contains sufficient TCR or Ig V sequence information to identify the specific V gene segment used. In one embodiment, the J segment primers hybridize with a conserved element of the J segment, and have similar annealing strength. In one particular embodiment, the J segment primers anneal to the same conserved framework region motif.

Oligonucleotides (e.g., primers) can be prepared by any suitable method, including direct chemical synthesis by a method such as the phosphotriester method of Narang et al., 1979, *Meth. Enzymol.* 68:90-99; the phosphodiester method of Brown et al., 1979, *Meth. Enzymol.* 68:109-151; the diethylphosphoramidite method of Beaucage et al., 1981, *Tetrahedron Lett.* 22:1859-1862; and the solid support method of U.S. Pat. No. 4,458,066, each incorporated herein by reference. A review of synthesis methods of conjugates of oligonucleotides and modified nucleotides is provided in Goodchild, 1990, *Bioconjugate Chemistry* 1(3): 165-187, incorporated herein by reference.

The term "primer," as used herein, refers to an oligonucleotide capable of acting as a point of initiation of DNA synthesis under suitable conditions. Such conditions include those in which synthesis of a primer extension product complementary to a nucleic acid strand is induced in the presence of four different nucleoside triphosphates and an agent for extension (e.g., a DNA polymerase or reverse transcriptase) in an appropriate buffer and at a suitable temperature.

A primer is preferably a single-stranded DNA, but in some embodiments may also include RNA. The appropriate length of a primer depends on the intended use of the primer but typically ranges from 6 to 50 nucleotides, or in certain embodiments, from 15-35 nucleotides. Short primer molecules generally require cooler temperatures to form sufficiently stable hybrid complexes with the template. A primer need not reflect the exact sequence of the template nucleic acid, but must be sufficiently complementary to hybridize with the template. The design of suitable primers for the amplification of a given target sequence is well known in the art and described in the literature cited herein.

As described herein, primers can incorporate additional features which allow for the detection or immobilization of the primer but do not alter the basic property of the primer, that of acting as a point of initiation of DNA synthesis. For example, primers may contain an additional nucleic acid sequence at the 5' end which does not hybridize to the target nucleic acid, but which facilitates cloning, detection, or sequencing of the amplified product. The region of the primer which is sufficiently complementary to the template to hybridize is referred to herein as the hybridizing region.

As used herein, a primer is "specific," for a target sequence if, when used in an amplification reaction under sufficiently stringent conditions, the primer hybridizes primarily to the target nucleic acid. Typically, a primer is specific for a target sequence if the primer-target duplex stability is greater than the stability of a duplex formed between the primer and any other sequence found in the sample. One of skill in the art will recognize that various factors, such as salt conditions as well as base composition of the primer and the location of the mismatches, will affect the specificity of the primer, and that routine experimental confirmation of the primer specificity will be needed in many cases. Hybridization conditions can be chosen under which the primer can form stable duplexes only with a target sequence. Thus, the use of target-specific primers under suitably stringent amplification conditions enables the selective amplification of those target sequences which contain the target primer binding sites.

In particular embodiments, primers for use in the methods described herein comprise or consist of a nucleic acid of at least about 15 nucleotides long that has the same sequence as, or is complementary to, a 15 nucleotide long contiguous sequence of the target V or J segment. Longer primers, e.g., those of about 16, 17, 18, 19, 20, 21, 22, 23, 24, 25, 26, 27, 28, 29, 30, 31, 32, 33, 34, 35, 36, 37, 38, 39, 40, 45, or 50, nucleotides long that have the same sequence as, or sequence complementary to, a contiguous sequence of the target V or J segment, will also be of use in certain embodiments. All intermediate lengths of the aforementioned primers are contemplated for use herein. As would be recognized by the skilled person, the primers may have additional sequence added (e.g., nucleotides that may not be the same as or complementary to the target V or J segment), such as restriction enzyme recognition sites, adaptor sequences for sequencing, bar code sequences, and the like (see e.g., primer sequences provided herein and in the sequence listing). Therefore, the length of the primers may be longer, such as 55, 56, 57, 58, 59, 60, 65, 70, 75, nucleotides in length or more, depending on the specific use or need. For example, in one embodiment, the forward and reverse primers are both modified at the 5' end with the universal forward primer sequence compatible with a DNA sequencer.

Also contemplated for use in certain embodiments are adaptive immune receptor V-segment or J-segment oligonucleotide primer variants that may share a high degree of sequence identity to the oligonucleotide primers for which nucleotide sequences are presented herein, including those set forth in the Sequence Listing. Thus, in these and related embodiments, adaptive immune receptor V-segment or J-segment oligonucleotide primer variants may have substantial identity to the adaptive immune receptor V-segment or J-segment oligonucleotide primer sequences disclosed herein, for example, such oligonucleotide primer variants may comprise at least 70% sequence identity, preferably at least 75%, 80%, 85%, 90%, 91%, 92%, 93%, 94%, 95%, 96%, 97%, 98%, or 99% or higher sequence identity compared to a reference polynucleotide sequence such as the oligonucleotide primer sequences disclosed herein, using the methods described herein (e.g., BLAST analysis using standard parameters). One skilled in this art will recognize that these values can be appropriately adjusted to determine corresponding ability of an oligonucleotide primer variant to anneal to an adaptive immune receptor segment-encoding polynucleotide by taking into account codon degeneracy, reading frame positioning and the like.

Typically, oligonucleotide primer variants will contain one or more substitutions, additions, deletions and/or insertions, preferably such that the annealing ability of the variant oligonucleotide is not substantially diminished relative to that of an adaptive immune receptor V-segment or J-segment oligonucleotide primer sequence that is specifically set forth herein. As also noted elsewhere herein, in preferred embodiments adaptive immune receptor V-segment and J-segment oligonucleotide primers are designed to be capable of amplifying a rearranged TCR or IGH sequence that includes the coding region for CDR3.

According to certain embodiments contemplated herein, the primers for use in the multiplex PCR methods of the present disclosure may be functionally blocked to prevent non-specific priming of non-T or B cell sequences. For example, the primers may be blocked with chemical modifications as described in U.S. patent application publication US2010/0167353. According to certain herein disclosed embodiments, the use of such blocked primers in the present multiplex PCR reactions involves primers that may have an inactive configuration wherein DNA replication (i.e., primer extension) is blocked, and an activated configuration wherein DNA replication proceeds. The inactive configuration of the primer is present when the primer is either single-stranded, or when the primer is specifically hybridized to the target DNA sequence of interest but primer extension remains blocked by a chemical moiety that is linked at or near to the 3' end of the primer.

The activated configuration of the primer is present when the primer is hybridized to the target nucleic acid sequence of interest and is subsequently acted upon by RNase H or another cleaving agent to remove the 3' blocking group, thereby allowing an enzyme (e.g., a DNA polymerase) to catalyze primer extension in an amplification reaction. Without wishing to be bound by theory, it is believed that the kinetics of the hybridization of such primers are akin to a second order reaction, and are therefore a function of the T cell or B cell gene sequence concentration in the mixture. Blocked primers minimize non-specific reactions by requiring hybridization to the target followed by cleavage before primer extension can proceed. If a primer hybridizes incorrectly to a sequence that is related to the desired target sequence but which differs by having one or more non-complementary nucleotides that result in base-pairing mismatches, cleavage of the primer is inhibited, especially when there is a mismatch that lies at or near the cleavage site. This strategy to improve the fidelity of amplification reduces the frequency of false priming at such locations, and thereby increases the specificity of the reaction. As would be recognized by the skilled person, reaction conditions, particularly the concentration of RNase H and the time allowed for hybridization and extension in each cycle, can be optimized to maximize the difference in cleavage efficiencies between highly efficient cleavage of the primer when it is correctly hybridized to its true target sequence, and poor cleavage of the primer when there is a mismatch between the primer and the template sequence to which it may be incompletely annealed.

As described in US2010/0167353, a number of blocking groups are known in the art that can be placed at or near the 3' end of the oligonucleotide (e.g., a primer) to prevent extension. A primer or other oligonucleotide may be modified at the 3'-terminal nucleotide to prevent or inhibit initiation of DNA synthesis by, for example, the addition of a 3' deoxyribonucleotide residue (e.g., cordycepin), a 2',3'-dideoxyribonucleotide residue, non-nucleotide linkages or alkane-diol modifications (U.S. Pat. No. 5,554,516). Alkane diol modifications which can be used to inhibit or block primer extension have also been described by Wilk et al., (1990 *Nucleic Acids Res.* 18 (8):2065), and by Arnold et al. (U.S. Pat. No. 6,031,091). Additional examples of suitable blocking groups include 3' hydroxyl substitutions (e.g., 3'-phosphate, 3'-triphosphate or 3'-phosphate diesters with alcohols such as 3-hydroxypropyl), 2'3'-cyclic phosphate, 2' hydroxyl substitutions of a terminal RNA base (e.g., phosphate or sterically bulky groups such as triisopropyl silyl (TIPS) or tert-butyl dimethyl silyl (TBDMS)). 2'-alkyl silyl groups such as TIPS and TBDMS substituted at the 3'-end of an oligonucleotide are described by Laikhter et al., U.S. patent application Ser. No. 11/686,894, which is incorporated herein by reference. Bulky substituents can also be incorporated on the base of the 3'-terminal residue of the oligonucleotide to block primer extension.

In certain embodiments, the oligonucleotide may comprise a cleavage domain that is located upstream (e.g., 5' to) of the blocking group used to inhibit primer extension. As examples, the cleavage domain may be an RNase H cleavage domain, or the cleavage domain may be an RNase H2 cleavage domain comprising a single RNA residue, or the oligonucleotide may comprise replacement of the RNA base with one or more alternative nucleosides. Additional illustrative cleavage domains are described in US2010/0167353.

Thus, a multiplex PCR system may use 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 85, or more forward primers, wherein each forward primer is complementary to a single functional TCR or Ig V segment or a small family of functional TCR or Ig V segments, e.g., a TCR Vβ segment (see e.g., the TCRBV primers as set forth in Table 1 and in the Sequence Listing, SEQ ID NOS:1644-1695) and, for example, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 85, or more reverse primers, each specific to a TCR or Ig J segment, such as TCR JR segment (see e.g., the TCRBJ primers in Table 1 and in the Sequence Listing, SEQ ID NOS:1631-1643). In another embodiment, a multiplex PCR reaction may use four forward primers each specific to one or more functional TCRγ V segment and four reverse primers each specific for one or more TCRγ J segments. In another embodiment, a multiplex PCR reaction may use 84 forward primers each specific to one or more functional V segments and six reverse primers each specific for one or more J segments.

Thermal cycling conditions may follow methods of those skilled in the art. For example, using a PCR Express™ thermal cycler (Hybaid, Ashford, UK), the following cycling conditions may be used: 1 cycle at 95° C. for 15 minutes, 25 to 40 cycles at 94° C. for 30 seconds, 59° C. for 30 seconds and 72° C. for 1 minute, followed by one cycle at 72° C. for 10 minutes. As will be recognized by the skilled person, thermal cycling conditions may be optimized, for example, by modifying annealing temperatures, annealing times, number of cycles and extension times. As would be recognized by the skilled person, the amount of primer and other PCR reagents used, as well as PCR parameters (e.g., annealing temperature, extension times and cycle numbers), may be optimized to achieve desired PCR amplification efficiency.

Alternatively, in certain related embodiments also contemplated herein, "digital PCR" methods can be used to quantitate the number of target genomes in a sample, without the need for a standard curve. In digital PCR, the PCR reaction for a single sample is performed in a multitude of more than 100 microcells or droplets, such that each droplet either amplifies (e.g., generation of an amplification product provides evidence of the presence of at least one template molecule in the microcell or droplet) or fails to amplify (evidence that the template was not present in a given microcell or droplet). By simply counting the number of positive microcells, it is possible directly to count the number of target genomes that are present in an input sample.

Digital PCR methods typically use an endpoint readout, rather than a conventional quantitative PCR signal that is measured after each cycle in the thermal cycling reaction (see, e.g., Pekin et al., 2011 *Lab. Chip* 11(13):2156; Zhong et al., 2011 *Lab. Chip* 11(13):2167; Tewhey et al., 2009 *Nature Biotechnol.* 27:1025; 2010 *Nature Biotechnol.* 28:178; Vogelstein and Kinzler, 1999 *Proc. Natl. Acad. Sci. USA* 96:9236-41; Pohl and Shih, 2004 *Expert Rev. Mol. Diagn.* 4(1); 41-7, 2004). Compared with traditional PCR, dPCR has the following advantages: (1) there is no need to rely on references or standards, (2) desired precision may be achieved by increasing the total number of PCR replicates, (3) it is highly tolerant to inhibitors, (4) it is capable of analyzing complex mixtures, and (5) it provides a linear response to the number of copies present in a sample to allow for small change in the copy number to be detected. Accordingly, any of the herein described compositions (e.g., template compositions and adaptive immune receptor gene-specific oligonucleotide primer sets) and methods may be adapted for use in such digital PCR methodology, for example, the ABI QuantStudio™ 12K Flex System (Life Technologies, Carlsbad, Calif.), the QX100™ Droplet Digital™ PCR system (BioRad, Hercules, Calif.), the QuantaLife™ digital PCR system (BioRad, Hercules, Calif.) or the RainDance™ microdroplet digital PCR system (RainDance Technologies, Lexington, Mass.).

Primers can be modified at either end (5' or 3') with the following modifications: TET (tetrachlorofluorescein) or BHQ_1 (4-(2-nitro-4-toloyldiazo)-2'-methoxy-5'-methyl-azobenzene-4"-(N-ethyl)-N-ethyl-2-cyanoethyl-(N,N-diisopropyl)-phosphoramidite). Certain primers (e.g., SEQ ID NOS: 5579-5643) can include a three-carbon spacer at the 3'-end on the hydroxyl group, preventing polymerase extension and amplification. In some embodiments, the first nucleotide of the primer is modified with a 6-carboxyfluorescein. The last nucleotide of the primer can be modified with a non-fluorescent quencher. In another embodiment, the primer has a minor groove-binding chemical modification (located at the second to last position at the 3'-end of the primer).

Quantifying Rearranged TCR and Ig Encoding DNA Molecules in a Sample

According to certain embodiments described herein, the proportion of lymphoid cells in a sample that are cancerous (e.g., malignant cells) can be determined. The present disclosure, however, also contemplates embodiments in which can be calculated the number of lymphoid cancer cells in a sample, out of the total number of input cells of the sample. The present disclosure also contemplates embodiments in which can be calculated the proportion of lymphoid cancer cells in a sample, out of the total number of input cells of the sample.

Briefly and by way of non-limiting example, to calculate the number of lymphoid cancer cells out of the total number of input cells from a sample, a known number of synthetic template oligonucleotide molecules of the herein described template composition for amplification factor determination, having sequences that correspond to the V and J priming sites, can be added ("spiked" in) to each amplification reaction of the presently disclosed methods. The synthetic template oligonucleotide molecules include a set of oligonucleotides that anneal to one V primer and one J primer, in the correct orientation, and a set of barcode oligonucleotides as described herein that uniquely identify each of the distinct synthetic template molecules. As described in greater detail elsewhere herein, these synthetic template oligonucleotide molecules may also include additional barcodes, additional unique identifying sets of oligonucleotide sequences, and universal primer sequences.

According to one embodiment, there is thus provided a template composition for amplification factor determination in which a known number of each of a plurality of template oligonucleotides having a unique oligonucleotide sequence is present, the template composition comprising: a plurality of template oligonucleotides having a plurality of oligonucleotide sequences of general formula:

5'-U1-B1-V-B2-R-B3-J-B4-U2-3'     [I]

wherein: (a) V is a polynucleotide comprising at least 20, 30, 60, 90, 120, 150, 180, or 210, and not more than 1000, 900, 800, 700, 600 or 500 contiguous nucleotides of an adaptive immune receptor variable (V) region encoding gene sequence, or the complement thereof, and in each of the plurality of oligonucleotide sequences V comprises a unique oligonucleotide sequence;

(b) J is a polynucleotide comprising at least 15-30, 31-60, 61-90, 91-120, or 120-150, and not more than 600, 500, 400, 300 or 200 contiguous nucleotides of an adaptive immune receptor joining (J) region encoding gene sequence, or the complement thereof, and in each of the plurality of oligonucleotide sequences J comprises a unique oligonucleotide sequence;

(c) U1 is either nothing or comprises an oligonucleotide having a sequence that is selected from (i) a first universal adaptor oligonucleotide sequence, and (ii) a first sequencing platform-specific oligonucleotide sequence that is linked to and positioned 5' to a first universal adaptor oligonucleotide sequence;

(d) U2 is either nothing or comprises an oligonucleotide having a sequence that is selected from (i) a second universal adaptor oligonucleotide sequence, and (ii) a second sequencing platform-specific oligonucleotide sequence that is linked to and positioned 5' to a second universal adaptor oligonucleotide sequence;

(e) B1, B2, B3, and B4 are each independently either nothing or each comprises an oligonucleotide B that comprises an oligonucleotide barcode sequence of 3, 4, 5, 6, 7, 8, 9, 10, 11, 12, 13, 14, 15, 16, 17, 18, 19, 20, 21, 22, 23, 24 or 25, contiguous nucleotides, wherein in each of the plurality of oligonucleotide sequences B comprises a unique oligonucleotide sequence that uniquely identifies, as a paired combination, (i) the unique V oligonucleotide sequence of (a) and (ii) the unique J oligonucleotide sequence of (b);

(f) R is either nothing or comprises a restriction enzyme recognition site that comprises an oligonucleotide sequence that is absent from (a)-(e), and wherein:

(g) at least one of: (i) the plurality of template oligonucleotides comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51-100, 101-200, 201-300, 301-400, 401-500, 501-600, 601-700, 701-800, 801-900, 901-1000, 1001-1100, 1101-1200, 1201-1300, 1301-1400, 1401-1500, 1501-1600, 1601-1700, 1701-2000, or 2001-2500 unique oligonucleotide sequences, (ii) the plurality of template oligonucleotides comprises at least one template oligonucleotide having an oligonucleotide sequence of general formula (I) to which each V-segment oligonucleotide primer can specifically hybridize and at least one template oligonucleotide having an oligonucleotide sequence of general formula (I) to which each J-segment oligonucleotide primer can specifically hybridize, or (iii) the plurality of template oligonucleotides comprises at least a or at least b unique oligonucleotide sequences, whichever is larger, where a is the number of unique adaptive immune receptor V region-encoding gene segments in the subject and b is the number of unique adaptive immune receptor J region-encoding gene segments in the subject, and the composition comprises at least one template oligonucleotide for each unique V polynucleotide and at least one template oligonucleotide for each unique J polynucleotide (FIG. 6).

Because the synthetic template oligonucleotide molecules each include a priming site for at least one of the V primers and one for the J primers, the multiplex TCR or IG amplification primers described herein also amplify these synthetic template oligonucleotide molecules when the synthetic templates are "spiked" into a multiplexed amplification reaction. The number of unique synthetic template molecules for amplification factor determination that may be added ("spiked" in) to the amplification reaction must be at least two, but may comprise a much larger number of unique sequences, for instance, enough unique species so that the template composition for amplification factor determination includes synthetic templates to which can anneal every possible pair of V and J primers.

Certain embodiments thus contemplate a template composition for amplification factor determination that comprises at least one template oligonucleotide having an oligonucleotide sequence of general formula (I) to which each V-segment oligonucleotide primer can specifically hybridize and at least one template oligonucleotide having an oligonucleotide sequence of general formula (I) to which each J-segment oligonucleotide primer can specifically hybridize.

Certain other embodiments thus contemplate a template composition for amplification factor determination that comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51-100, 101-200, 201-300, 301-400, 401-500, 501-600, 601-700, 701-800, 801-900, 901-1000, 1001-1100, 1101-1200, 1201-1300, 1301-1400, 1401-1500, 1501-1600, 1601-1700, 1701-2000, or 2001-2500 unique oligonucleotide sequences.

Certain other embodiments thus contemplate a template composition for amplification factor determination that comprises at least a or at least b unique oligonucleotide sequences, whichever is larger, where a is the number of unique adaptive immune receptor V region-encoding gene segments in the subject and b is the number of unique adaptive immune receptor J region-encoding gene segments in the subject, and the composition comprises at least one template oligonucleotide for each unique V polynucleotide and at least one template oligonucleotide for each unique J polynucleotide.

In practice, for example, if a known number of synthetic template oligonucleotide molecules, each with a unique barcode (B) tracking sequence, are added to a multiplexed amplification reaction for amplifying rearranged DNA sequences that encode an adaptive immune receptor, the amplification products of which are then quantitatively sequenced, the number of sequenced molecules can be used to calculate the number of times each input molecule was amplified. This parameter, described in greater detail below, may be referred to as the amplification factor.

In a non-limiting and exemplary simplified application, the amplification factor can be calculated as: Amplification Factor=Number of Sequenced Synthetic Template Oligonucleotide Molecules/Number of Input Synthetic Template Oligonucleotide Molecules. In other embodiments, the amplification factor can be calculated for each sequence-unique species of synthetic template oligonucleotide molecule that is included in a multiplexed amplification reaction, to obtain a distribution of amplification factors for the reaction. The median of this distribution can be used as the final amplification factor for the calculation of the number of unique adaptive immune receptor encoding DNA molecules in the sample. If the amplification factor is uniquely calculated for each type of synthetic template oligonucleotide molecule of the template composition for amplification factor determination, information about primer amplification bias (e.g., detectable statistically significant differences in the efficiencies with which different amplification primers amplify their cognate template sequences) can be obtained and used to correct for such bias that may be introduced during the multiplexed amplification reaction.

As another non-limiting example, by using (i) the amplification factor value that is determined by quantifying the amplification products of the synthetic template oligonucleotide molecules of the template composition for amplification factor determination, and (ii) the number of rearranged DNA molecules encoding adaptive immune receptors that are detected by quantitative sequencing of multiplexed amplification products, the starting number of adaptive immune cells in the sample can be calculated. This calculation is: Number of Input Cells Having Rearranged DNA Encoding Adaptive Immune Receptors=Number of Adaptive Immune Receptor Sequences/Amplification Factor. From determination in this manner of the number of input cells in the sample that have rearranged DNA encoding adaptive immune receptors, a probable count of the number of lymphoid cancer cells in the sample can be calculated.

In certain embodiments, alternatively or additionally (e.g., in parallel), the proportion of total cells in the sample that carry a rearranged adaptive immune receptor encoding DNA sequence that is associated with lymphoid cancer cells can be calculated. In these and related embodiments, the amplification reaction includes the V and J multiplex primers and also includes a set of control primers that amplify a genomic region with known and consistent copy number. Suitable target genes for these control primers include housekeeping genes, for example, HLA-DRB1, ABO, ZFXY, or other widely and constitutively expressed genes. Non-limiting examples of such primers are shown in Table 2. The control primers amplify a set region of the genome. To efficiently use sequencer flow cell space by maximizing the portion used for determining adaptive immune receptor encoding sequences and minimizing that for determining the genomic control sequences, the primers may be modified to reduce efficient PCR amplification. The genomic control primers amplification efficiency may be limited, for example, by altering the primer sequences to introduce mismatches, and/or these primers can be included in the amplification reaction at low concentration. While these modifications are not necessary, they may increase sequencing throughput. To estimate the proportion of the total cells that are cancerous lymphoid cells, the final number of target gene sequences may then be counted.

TABLE 2

Exemplary Control (Housekeeping Gene) Primers

| Target Gene | Forward Primer | SEQ ID NO: | Reverse Primer | SEQ ID NO: |
|---|---|---|---|---|
| HLA-DRB1 | GGATGATAAATAGGTGCCAAGTG | 6383 | ACTTCAATGCTGCCTGGAT | 6384 |
| ABO | AAGGACGAGGGCGATTTCTA | 6385 | TATCTGCGATTGCGTGTCTG | 6386 |
| ZFXY | TTGCATGATTTGTGGGAAGA | 6387 | TTCTGAAGGCCTGTGAAAGC | 6388 |

Further details regarding determination of amplification factor values using the herein described template composition for amplification factor determination are presented below. The template composition for amplification factor determination comprises a plurality of diverse template oligonucleotides of general formula (I) as described in greater detail herein:

$$5'\text{-}U1\text{-}B1\text{-}V\text{-}B2\text{-}R\text{-}B3\text{-}J\text{-}B4\text{-}U2\text{-}3' \qquad (I)$$

The constituent template oligonucleotides, of which the template composition is comprised, are diverse with respect to the nucleotide sequences of the individual template oligonucleotides. The individual template oligonucleotides thus may vary in nucleotide sequence considerably from one another as a function of significant sequence variability amongst the large number of possible TCR or BCR variable (V) and joining (J) region polynucleotides. Sequences of individual template oligonucleotide species may also vary from one another as a function of sequence differences in U1, U2, B (B1, B2, B3, and B4) and R oligonucleotides that are included in a particular template within the diverse plurality of templates.

In certain embodiments barcode oligonucleotides B (B1, B2, B3, and B4) may independently and optionally comprise an oligonucleotide barcode sequence, wherein the barcode sequence is selected to identify uniquely a particular paired combination of a particular unique V oligonucleotide sequence and a particular unique J oligonucleotide sequence. The relative positioning of the barcode oligonucleotides B1 and B4 and universal adaptors advantageously permits rapid identification and quantification of the amplification products of a given unique template oligonucleotide by short sequence reads and paired-end sequencing on automated DNA sequencers (e.g., Illumina HiSeq™ or Illumina MiSEQ®, or GeneAnalyzer™-2, Illumina Corp., San Diego, Calif.). In particular, these and related embodiments permit rapid high-throughput determination of specific combinations of a V and a J sequence that are present in an amplification product, thereby to characterize the relative amplification efficiency of each V-specific primer and each J-specific primer that may be present in a primer set which is capable of amplifying rearranged TCR or BCR encoding DNA in a sample. Verification of the identities and/or quantities of the amplification products may be accomplished by longer sequence reads, optionally including sequence reads that extend to B2.

In use, each template oligonucleotide in the plurality of template oligonucleotides is present in a substantially equimolar amount, which in certain preferred embodiments includes preparations in which the molar concentrations of all oligonucleotides are within 1, 2, 3, 4, 5, 6, 7, 8, 9, 10, 11, 12, 13, 14, 15, 16, 17, 18, 19, 20, 21, 22, 23, 24 or 25 percent of each other. In certain other preferred embodiments as provided herein, template oligonucleotides are regarded as being present in a substantially equimolar amount when the molar concentrations of all oligonucleotides are within one order of magnitude of each other, including preparations in which the greatest molar concentration that any given unique template oligonucleotide species may have is no more than 1000, 900, 800, 700, 600, 500, 440, 400, 350, 300, 250, 200, 150, 100, 90, 80, 70, 60, 50, 40 or 30 percent greater than the molar concentration at which is present the unique template oligonucleotide species having the lowest concentration in the composition.

In a similar manner, certain embodiments disclosed herein contemplate oligonucleotide primer sets for amplification, in which sets the component primers may be provided in substantially equimolar amounts. As also described herein, according to certain other embodiments, the concentration of one or more primers in a primer set may be adjusted deliberately so that certain primers are not present in equimolar amounts or in substantially equimolar amounts.

Preferably all templates in the template composition for amplification factor determination, which is described herein and which comprises a plurality of template oligonucleotides having diverse sequences and the general structure of general formula (I), are oligonucleotides of substantially identical length. Without wishing to be bound by theory, it is generally believed that in a nucleic acid amplification reaction such as a polymerase chain reaction (PCR), template DNA length can influence the amplification efficiency of oligonucleotide primers by affecting the kinetics of interactions between primers and template DNA molecules to which the primers anneal by specific, nucleotide sequence-directed hybridization through nucleotide base complementarity. Longer templates are generally regarded as operating less efficiently than relatively shorter templates. In certain embodiments, the presently disclosed template composition for amplification factor determination comprises a plurality of template oligonucleotides of general formula (I) as provided herein, wherein the template oligonucleotides are of an identical length or a substantially identical length that is not more than 1000, 950, 900, 850, 800, 750, 700, 650, 600, 550, 500, 450, 400, 350, 300, 250, 200, 150 or 100 nucleotides in length, including all integer values therebetween.

Accordingly, in order to reduce, remove or minimize the potential contribution to undesirable biases in oligonucleotide primer utilization during multiplexed amplification, preferred embodiments disclosed herein may employ a plurality of template oligonucleotides wherein all template oligonucleotides in the sequence-diverse plurality of template oligonucleotides are of substantially identical length. A plurality of template oligonucleotides may be of substantially identical length when all (e.g., 100%) or most (e.g., greater than 50%) such oligonucleotides in a template composition are oligonucleotides that each have the exact same number of nucleotides, or where one or more template oligonucleotides in the template composition may vary in length from one another by no more than 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 90 or 100 nucleotides in length. It will be appreciated from the present disclosure that even in situations where not all template oligonucleotides have exactly the same length, the herein described compositions and methods may still be employed to determine an amplification factor as described herein.

According to certain presently disclosed embodiments, (i) each template oligonucleotide of the presently described template composition is provided in a substantially equimolar amount, (ii) the oligonucleotide primer set that is capable of amplifying rearranged DNA encoding a plurality of adaptive immune receptor comprises a plurality of V-segment oligonucleotide primers that are provided in substantially equimolar amounts, (iii) the oligonucleotide primer set that is capable of amplifying rearranged DNA encoding a plurality of adaptive immune receptor comprises a plurality of J-segment oligonucleotide primers that are provided in substantially equimolar amounts, and (iv) amplification scales linearly with the number of starting templates of a given sequence.

Hence, an expected yield for the amplification product of each template can be calculated and arbitrarily assigned a theoretical uniform amplification level value of 100%. After permitting the primer sets to amplify the sequences of the template oligonucleotides in an amplification reaction, any statistically significant deviation from substantial equivalence that is observed among the relative proportions of distinct amplification products indicates that there has been bias (i.e., unequal efficiency) in primer utilization during amplification. In other words, quantitative differences in the relative amounts of different amplification products that are obtained indicate that not all primers in the primer set have amplified their respective templates with comparable efficiencies. Certain embodiments contemplate assigning a range of tolerances above and below a theoretical 100% yield, such that any amplification level value within the range of tolerances may be regarded as substantial equivalence.

In certain such embodiments, the range of amplification product yields may be regarded as substantially equivalent when the product yields are all within the same order of magnitude (e.g., differ by less than a factor of ten). In certain other such embodiments, the range of amplification product yields may be regarded as substantially equivalent when the product yields differ from one another by no more than nine-fold, eight-fold, seven-fold, six-fold, five-fold, four-fold or three-fold. In certain other embodiments, product yields that may be regarded as being within an acceptable tolerance range may be more or less than a calculated 100% yield by as much as 1, 2, 3, 4, 5, 6, 7, 8, 9, 10, 11, 12, 13, 14, 15, 16, 17, 18, 19, 20, 30, 40, 50, 60, 100, or 200%.

Because the method involves determining the nucleotide sequence of each amplification product using known techniques as part of the quantification process, the primer(s)

responsible for amplification of each unique (as defined by sequence) product can be identified and their relative amount(s) in the primer set can be adjusted (e.g., increased or decreased in a statistically significant manner) accordingly. The concentrations of excessively efficient primers in the primer set can be reduced relative to the concentrations of other primers, so that the level of specific amplification by such primers of templates in the herein described template composition is substantially equivalent to the level of amplification delivered by the majority of primers which deliver the theoretical uniform amplification level, or which deliver a level that is within the acceptable tolerance range. The concentrations of poorly efficient primers in the primer set can be increased relative to the concentrations of other primers, so that the level of specific amplification by such primers of templates in the herein described template composition is substantially equivalent to the level of amplification delivered by the majority of primers which deliver the theoretical uniform amplification level, or which deliver a level within the acceptable tolerance range.

By providing the herein described template composition as a standard with which oligonucleotide primer sets can be calibrated, and in particular embodiments, where each template oligonucleotide is present in a substantially equimolar amount so that individual primer concentrations can be adjusted to yield substantially uniform amplification of a structurally diverse array of amplification products, the present disclosure thus advantageously overcomes the above described problems associated with biases in individual primer efficiency.

Using the compositions and methods provided herein, individual primers may be identified as having a non-uniform amplification potential by virtue of their promotion of non-uniform amplification as evidenced by increased (e.g., greater in a statistically significant manner) or decreased (e.g., lower in a statistically significant manner) amplification of specific template oligonucleotides relative to the uniform amplification level, despite the presence in an amplification reaction (i) of all template oligonucleotides in substantially equimolar amounts to one another, (ii) of all V-segment primers in substantially equimolar amounts to one another, and (iii) of all J-segment primers in substantially equimolar amounts to one another.

The relative concentrations of such primers may then be decreased or increased to obtain a modified complete set of primers in which all primers are not present in substantially equimolar amounts relative to one another, to compensate, respectively, for the increased or decreased level of amplification relative to the uniform amplification level. The primer set may then be retested for its ability to amplify all sequences in the herein disclosed template composition at the uniform amplification level, or within an acceptable tolerance range.

The process of testing modified primer sets for their ability to amplify the herein disclosed template composition, in which all template oligonucleotides are provided in substantially equimolar amounts to one another, may be repeated iteratively until all products are amplified at the uniform amplification level, or within an acceptable tolerance range. By such a process using the herein disclosed template composition, the amplification efficiency of an oligonucleotide primer set may be standardized, where the primer set is capable of amplifying productively rearranged DNA encoding one or a plurality of adaptive immune receptors in a biological sample that comprises DNA from lymphoid cells of a subject.

Additionally or alternatively, according to the present disclosure it may be determined whether any particular pair of oligonucleotide amplification primers exhibits non-uniform amplification potential, such as increased or decreased amplification of the template composition relative to a uniform amplification level exhibited by a majority of the oligonucleotide amplification primers, and a normalizing adjustment factor can then be used to calculate, respectively, a proportionately decreased or increased relative frequency of occurrence of the amplification products that are promoted by each such amplification primer pair. The present template compositions thus, in certain embodiments, provide a method of correcting for non-uniform nucleic acid amplification potential among members of a set of oligonucleotide amplification primers.

Certain such embodiments may advantageously permit correction, calibration, standardization, normalization, or the like, of data that are obtained as a consequence of non-uniform amplification events. Thus, the present embodiments permit correction of data inaccuracies, such as may result from biased oligonucleotide primer utilization, without the need for iteratively adjusting the concentrations of one or more amplification primers and repeating the steps of amplifying the herein described template compositions. Advantageous efficiencies may thus be obtained where repetition of the steps of quantitatively sequencing the amplification products can be avoided. Certain other contemplated embodiments may, however, employ such an iterative approach.

Accordingly, and as described herein, there is presently provided a template composition for amplification factor determination, along with methods for using such a template composition. Also described herein are methods for correcting such non-uniform nucleic acid amplification potentials (e.g., biases) among members of the oligonucleotide primer set. These and related embodiments exploit previously unrecognized benefits that are obtained by calibrating complex oligonucleotide primer sets to compensate for undesirable amplification biases using the template composition for amplification factor determination having the features described herein, and will find uses in improving the accuracy with which specific clonotypic TCR and/or Ig encoding DNA sequences can be quantified, relative to previously described methodologies.

As also noted above and described elsewhere herein, prior to the present disclosure there existed, in certain situations, unsatisfactory and difficult-to-discern discrepancies between (i) the actual quantitative distribution of rearranged adaptive immune receptor-encoding DNA templates having unique sequences in a biological sample comprising lymphoid cell DNA from a subject, and (ii) the observed relative representation of nucleic acid amplification products of such templates that were detected, following multiplexed amplification using a complex set of oligonucleotide amplification primers designed to amplify substantially all productively rearranged adaptive immune receptor genes in the sample.

TEMPLATES. According to certain preferred embodiments there is thus provided a template composition for amplification factor determination, for use in a multiplexed nucleic acid amplification reaction with an oligonucleotide primer set that is capable of amplifying rearranged DNA (which in certain embodiments may refer to productively rearranged DNA but which in certain other embodiments need not be so limited) encoding one or a plurality of adaptive immune receptors in a biological sample that comprises DNA from lymphoid cells of a subject, the template composition comprising a plurality of template oligonucleotides of general formula (I):

5'-U1-B1-V-B2-R-B3-J-B4-U2-3'                  (I)

as provided herein. In certain preferred embodiments each template oligonucleotide in the plurality of template oligonucleotides is present in a substantially equimolar amount, which in certain embodiments and as noted above may refer to a composition in which each of the template oligonucleotides is present at an equimolar concentration or at a molar concentration that deviates from equimolar by no more than 1, 2, 3, 4, 5, 6, 7, 8, 9, 10, 11, 12, 13, 14, 15, 16, 17, 18, 19, 20, 21, 22, 23, 24, 25, 50, 60, 70, 80, 90, 100 or 200% on a molar basis, and which in certain other embodiments may refer to a composition in which all of the template oligonucleotides are present at molar concentrations that are within an order of magnitude of one another. The plurality of templates may comprise at least 100, 200, 300, 400, 500, 600, 700, 800, 900, 1000, 1100 or more discrete oligonucleotide species each having a distinct nucleotide sequence, including every intermediate integer value therebetween.

The herein disclosed template composition thus comprises a plurality of template oligonucleotides of general formula:

5'-U1-B1-V-B2-R-B3-J-B4-U2-3'                  [I]

wherein, briefly and as elaborated in greater detail elsewhere herein, according to certain preferred embodiments:

V is a polynucleotide comprising at least 20, 30, 60, 90, 120, 150, 180, or 210, and not more than 1000, 900, 800, 700, 600 or 500 contiguous nucleotides of an adaptive immune receptor variable (V) region encoding gene sequence, or the complement thereof, and in each of the plurality of template oligonucleotide sequences V comprises a unique oligonucleotide sequence;

J is a polynucleotide comprising at least 15-30, 31-60, 61-90, 91-120, or 120-150, and not more than 600, 500, 400, 300 or 200 contiguous nucleotides of an adaptive immune receptor joining (J) region encoding gene sequence, or the complement thereof, and in each of the plurality of template oligonucleotide sequences J comprises a unique oligonucleotide sequence;

U1 and U2 are each either nothing or each comprise an oligonucleotide having, independently, a sequence that is selected from (i) a universal adaptor oligonucleotide sequence, and (ii) a sequencing platform-specific oligonucleotide sequence that is linked to and positioned 5' to the universal adaptor oligonucleotide sequence;

B1, B2, B3. and B4 are each independently either nothing or each comprise an oligonucleotide B that comprises an oligonucleotide barcode sequence of 3, 4, 5, 6, 7, 8, 9, 10, 11, 12, 13, 14, 15, 16, 17, 18, 19, 20, 25, 30, 35, 40, 45, 50, 60, 70, 80, 90, 100, 200, 300, 400, 500, 600, 700, 800, 900 or 1000 contiguous nucleotides (including all integer values therebetween), wherein in each of the plurality of template oligonucleotide sequences B comprises a unique oligonucleotide sequence that uniquely identifies, or identifies as a paired combination, (i) the unique V oligonucleotide sequence of the template oligonucleotide and (ii) the unique J oligonucleotide sequence of the template oligonucleotide; and R is either nothing or comprises a restriction enzyme recognition site that comprises an oligonucleotide sequence that is absent from V, J, U1, U2, B1, B2, B3, and B4.

In certain preferred embodiments the template composition comprises at least one template oligonucleotide to which each oligonucleotide amplification primer in an amplification primer set can anneal. That is, in certain preferred embodiments the template composition comprises at least one template oligonucleotide having an oligonucleotide sequence of general formula (I) to which each V-segment oligonucleotide primer can specifically hybridize, and at least one template oligonucleotide having an oligonucleotide sequence of general formula (I) to which each J-segment oligonucleotide primer can specifically hybridize.

According to such embodiments the oligonucleotide primer set that is capable of amplifying rearranged DNA encoding one or a plurality of adaptive immune receptors comprises a plurality a of unique V-segment oligonucleotide primers and a plurality b of unique J-segment oligonucleotide primers. The plurality of a V-segment oligonucleotide primers are each independently capable of annealing or specifically hybridizing to at least one polynucleotide encoding an adaptive immune receptor V-region polypeptide or to the complement thereof, wherein each V-segment primer comprises a nucleotide sequence of at least 15 contiguous nucleotides that is complementary to at least one adaptive immune receptor V region-encoding gene segment. The plurality of b J-segment oligonucleotide primers are each independently capable of annealing or specifically hybridizing to at least one polynucleotide encoding an adaptive immune receptor J-region polypeptide or to the complement thereof, wherein each J-segment primer comprises a nucleotide sequence of at least 15 contiguous nucleotides that is complementary to at least one adaptive immune receptor J region-encoding gene segment.

Thus, in certain embodiments and as also discussed elsewhere herein, the present template composition may be used in amplification reactions with amplification primers that are designed to amplify all rearranged adaptive immune receptor encoding gene sequences, including those that are not expressed, while in certain other embodiments the template composition and amplification primers may be designed so as not to yield amplification products of rearranged genes that are not expressed (e.g., pseudogenes, orphons). It will therefore be appreciated that in certain embodiments only a subset of rearranged adaptive immune receptor encoding genes may desirably be amplified, such that suitable amplification primer subsets may be designed and employed to amplify only those rearranged V-J sequences that are of interest. In these and related embodiments, correspondingly, a herein described template composition comprising only a subset of interest of rearranged V-J rearranged sequences may be used, so long as the template composition comprises at least one template oligonucleotide to which each oligonucleotide amplification primer in an amplification primer set can anneal. The actual number of template oligonucleotides in the template composition may thus vary considerably among the contemplated embodiments, as a function of the amplification primer set that is to be used.

For example, in certain related embodiments, in the template composition the plurality of template oligonucleotides may have a plurality of sequences of general formula (I) that is selected from (1) the plurality of oligonucleotide sequences of general formula (I) in which polynucleotides V and J have the TCRB V and J sequences set forth in at least one set of 68 TCRB V and J SEQ ID NOS, respectively, as set forth in FIG. 9 as TCRB V/J set 1, TCRB V/J set 2, TCRB V/J set 3, TCRB V/J set 4, TCRB V/J set 5, TCRB V/J set 6, TCRB V/J set 7, TCRB V/J set 8, TCRB V/J set 9, TCRB V/J set 10, TCRB V/J set 11, TCRB V/J set 12 and TCRB V/J set 13; (2) the plurality of oligonucleotide sequences of general formula (I) in which polynucleotides V and J have the TCRG V and J sequences set forth in at least one set of 14 TCRG V and J SEQ ID NOS, respectively, as set forth in FIG. 10 as TCRG V/J set 1, TCRG V/J set 2, TCRG V/J set 3, TCRG V/J set 4 and TCRG V/J set 5; and (3) the plurality of oligonucleotide sequences of general formula (I) in which polynucleotides V and J have the IGH V and J sequences set forth in at least one set of 127 IGH V and J SEQ ID NOS, respectively, as set forth in FIG. 11 as IGH V/J set 1, IGH V/J set 2, IGH V/J set 3, IGH V/J set 4, IGH V/J set 5, IGH V/J set 6, IGH V/J set 7, IGH V/J set 8 and IGH V/J set 9.

In certain embodiments, V is a polynucleotide sequence that encodes at least 10-70 contiguous amino acids of an adaptive immune receptor V-region, or the complement thereof; J is a polynucleotide sequence that encodes at least 5-30 contiguous amino acids of an adaptive immune receptor J-region, or the complement thereof; U1 and U2 are each either nothing or comprise an oligonucleotide comprising a nucleotide sequence that is selected from (i) a universal adaptor oligonucleotide sequence, and (ii) a sequencing platform-specific oligonucleotide sequence that is linked to and positioned 5' to the universal adaptor oligonucleotide sequence; B1, B2, B3 and B4 are each independently either nothing or each comprise an oligonucleotide B that comprises an oligonucleotide barcode sequence of 3, 4, 5, 6, 7, 8, 9, 10, 11, 12, 13, 14, 15, 16, 17, 18, 19 or 20 contiguous nucleotides, wherein in each of the plurality of oligonucleotide sequences B comprises a unique oligonucleotide sequence that uniquely identifies, as a paired combination, (i) the unique V oligonucleotide sequence and (ii) the unique J oligonucleotide sequence; and R is either nothing or comprises a restriction enzyme recognition site that comprises an oligonucleotide sequence that is absent from V, J, U1, U2, B1, B2, B3, and B4.

A large number of adaptive immune receptor variable (V) region and joining (J) region gene sequences are known as nucleotide and/or amino acid sequences, including non-rearranged genomic DNA sequences of TCR and Ig loci, and productively rearranged DNA sequences at such loci and their encoded products, and also including pseudogenes at these loci, and also including related orphons. See, e.g., U.S. application Ser. No. 13/217,126; U.S. application Ser. No. 12/794,507; PCT/US2011/026373; PCT/US2011/049012. These and other sequences known to the art may be used according to the present disclosure for the design and production of template oligonucleotides to be included in the presently provided template composition for standardizing amplification efficiency of an oligonucleotide primer set, and for the design and production of the oligonucleotide primer set that is capable of amplifying rearranged DNA encoding TCR or Ig polypeptide chains, which rearranged DNA may be present in a biological sample comprising lymphoid cell DNA.

In formula (I), V is a polynucleotide sequence of at least 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400 or 450 and not more than 1000, 900, 800, 700, 600 or 500 contiguous nucleotides of an adaptive immune receptor (e.g., TCR or BCR) variable (V) region gene sequence, or the complement thereof, and in each of the plurality of oligonucleotide sequences V comprises a unique oligonucleotide sequence. Genomic sequences for TCR and BCR V region genes of humans and other species are known and available from public databases such as Genbank; V region gene sequences include polynucleotide sequences that encode the products of expressed, rearranged TCR and BCR genes and also include polynucleotide sequences of pseudogenes that have been identified in the V region loci. The diverse V polynucleotide sequences that may be incorporated into the presently disclosed templates of general formula (I) may vary widely in length, in nucleotide composition (e.g., GC content), and in actual linear polynucleotide sequence, and are known, for example, to include "hot spots" or hypervariable regions that exhibit particular sequence diversity.

The polynucleotide V in general formula (I) (or its complement) includes sequences to which members of oligonucleotide primer sets specific for TCR or BCR genes can specifically anneal. Primer sets that are capable of amplifying rearranged DNA encoding a plurality of TCR or BCR are described, for example, in U.S. application Ser. No. 13/217, 126; U.S. application Ser. No. 12/794,507; PCT/US2011/026373; or PCT/US2011/049012; or the like; or as described therein may be designed to include oligonucleotide sequences that can specifically hybridize to each unique V gene and to each J gene in a particular TCR or BCR gene locus (e.g., TCR α, β, γ or δ, or IgH μ, γ, δ, α or ε, or IgL κ or λ). For example by way of illustration and not limitation, an oligonucleotide primer of an oligonucleotide primer amplification set that is capable of amplifying rearranged DNA encoding one or a plurality of TCR or BCR may typically include a nucleotide sequence of 15, 16, 17, 18, 19, 20, 21, 22, 23, 24, 25, 26, 27, 28, 29, 30, 31, 32, 33, 34, 35, 36, 37, 38, 39 or 40 contiguous nucleotides, or more, and may specifically anneal to a complementary sequence of 15, 16, 17, 18, 19, 20, 21, 22, 23, 24, 25, 26, 27, 28, 29, 30, 31, 32, 33, 34, 35, 36, 37, 38, 39 or 40 contiguous nucleotides of a V or a J polynucleotide as provided herein. In certain embodiments the primers may comprise at least 19, 20, 21, 22, 23, 24, 25, 26, 27, 28, 29 or 30 nucleotides, and in certain embodiment the primers may comprise sequences of no more than 15, 16, 17, 18, 19, 20, 21, 22, 23, 24, 25, 26, 27, 28, 29, 30, 31, 32, 33, 34, 35, 36, 37, 38, 39 or 40 contiguous nucleotides. Primers and primer annealing sites of other lengths are also expressly contemplated, as disclosed herein.

The entire polynucleotide sequence of each polynucleotide V in general formula (I) may, but need not, consist exclusively of contiguous nucleotides from each distinct V gene. For example and according to certain embodiments, in the template composition described herein, each polynucleotide V of formula (I) need only have at least a region comprising a unique V oligonucleotide sequence that is found in one V gene and to which a single V region primer in the primer set can specifically anneal. Thus, the V polynucleotide of formula (I) may comprise all or any prescribed portion (e.g., at least 15, 20, 30, 60, 90, 120, 150, 180 or 210 contiguous nucleotides, or any integer value therebetween) of a naturally occurring V gene sequence (including a V pseudogene sequence) so long as at least one unique V oligonucleotide sequence region (the primer annealing site) is included that is not included in any other template V polynucleotide.

It may be preferred in certain embodiments that the plurality of V polynucleotides that are present in the herein described template composition have lengths that simulate the overall lengths of known, naturally occurring V gene nucleotide sequences, even where the specific nucleotide sequences differ between the template V region and any naturally occurring V gene. The V region lengths in the herein described templates may differ from the lengths of naturally occurring V gene sequences by no more than 1, 2, 3, 4, 5, 6, 7, 8, 9, 10, 11, 12, 13, 14, 15, 16, 17, 18, 19 or 20 percent.

The V polynucleotide in formula (I) may thus, in certain embodiments, comprise a nucleotide sequence having a length that is the same or similar to that of the length of a typical V gene from its start codon to its CDR3 encoding region and may, but need not, include a nucleotide sequence that encodes the CDR3 region. CDR3 encoding nucleotide sequences and sequence lengths may vary considerably and have been characterized by several different numbering schemes (e.g., Lefranc, 1999 *The Immunologist* 7:132; Kabat et al., 1991 *In: Sequences of Proteins of Immunological Interest*, NIH Publication 91-3242; Chothia et al., 1987 *J. Mol. Biol.* 196:901; Chothia et al., 1989 *Nature* 342:877; Al-Lazikani et al., 1997 *J. Mol. Biol.* 273:927; see also, e.g., Rock et al., 1994 *J. Exp. Med.* 179:323; Saada et al., 2007 *Immunol. Cell Biol.* 85:323).

Briefly, the CDR3 region typically spans the polypeptide portion extending from a highly conserved cysteine residue (encoded by the trinucleotide codon TGY; Y=T or C) in the V segment to a highly conserved phenylalanine residue (encoded by TTY) in the J segment of TCRs, or to a highly conserved tryptophan (encoded by TGG) in IGH. More than 90% of natural, productive rearrangements in the TCRB locus have a CDR3 encoding length by this criterion of between 24 and 54 nucleotides, corresponding to between 9 and 17 encoded amino acids. The CDR3 lengths of the presently disclosed synthetic template oligonucleotides should, for any given TCR or BCR locus, fall within the same range as 95% of naturally occurring rearrangements. Thus, for example, in a herein described template composition for amplification factor determination, the CDR3 encoding portion of the V polynucleotide may have a length of from 24 to 54 nucleotides, including every integer therebetween. The numbering schemes for CDR3 encoding regions described above denote the positions of the conserved cysteine, phenylalanine and tryptophan codons, and these numbering schemes may also be applied to pseudogenes in which one or more codons encoding these conserved amino acids may have been replaced with a codon encoding a different amino acid. For pseudogenes which do not use these conserved amino acids, the CDR3 length may be defined relative to the corresponding position at which the conserved residue would have been observed absent the substitution, according to one of the established CDR3 sequence position numbering schemes referenced above.

It may also be preferred, in certain embodiments, that the plurality of V polynucleotides that are present in the herein described template composition have nucleotide compositions (e.g., percentage of GC content) that simulate the overall nucleotide compositions of known, naturally occurring V gene sequences, even where the specific nucleotide sequences differ. Such template V region nucleotide compositions may differ from the nucleotide compositions of naturally occurring V gene sequences by no more than 1, 2, 3, 4, 5, 6, 7, 8, 9, 10, 11, 12, 13, 14, 15, 16, 17, 18, 19 or 20 percent. Optionally and according to certain embodiments, the V polynucleotide of the herein described template oligonucleotide includes a stop codon at or near the 3' end of V in general formula (I).

In formula (I) J is a polynucleotide comprising at least 15-30, 31-60, 61-90, 91-120, or 120-150, and not more than 600, 500, 400, 300 or 200 contiguous nucleotides of an adaptive immune receptor joining (J) region encoding gene sequence, or the complement thereof, and in each of the plurality of oligonucleotide sequences J comprises a unique oligonucleotide sequence.

The polynucleotide J in general formula (I) (or its complement) includes sequences to which members of oligonucleotide primer sets specific for TCR or BCR genes can specifically anneal. Primer sets that are capable of amplifying rearranged DNA encoding a plurality of TCR or BCR are described, for example, in U.S. application Ser. No. 13/217,126; U.S. application Ser. No. 12/794,507; PCT/US2011/026373; or PCT/US2011/049012; or the like; or as described therein may be designed to include oligonucleotide sequences that can specifically hybridize to each unique V gene and to each unique J gene in a particular TCR or BCR gene locus (e.g., TCR α, β, γ or δ, or IgH μ, γ, δ, α or ε, or IgL κ or λ).

The entire polynucleotide sequence of each polynucleotide J in general formula (I) may, but need not, consist exclusively of contiguous nucleotides from each distinct J gene. For example and according to certain embodiments, in the template composition described herein, each polynucleotide J of formula (I) need only have at least a region comprising a unique J oligonucleotide sequence that is found in one J gene and to which a single V region primer in the primer set can specifically anneal. Thus, the V polynucleotide of formula (I) may comprise all or any prescribed portion (e.g., at least 15, 20, 30, 60, 90, 120, 150, 180 or 210 contiguous nucleotides, or any integer value therebetween) of a naturally occurring V gene sequence (including a V pseudogene sequence) so long as at least one unique V oligonucleotide sequence region (the primer annealing site) is included that is not included in any other template J polynucleotide.

It may be preferred in certain embodiments that the plurality of J polynucleotides that are present in the herein described template composition have lengths that simulate the overall lengths of known, naturally occurring J gene nucleotide sequences, even where the specific nucleotide sequences differ between the template J region and any naturally occurring J gene. The J region lengths in the herein described templates may differ from the lengths of naturally occurring J gene sequences by no more than 1, 2, 3, 4, 5, 6, 7, 8, 9, 10, 11, 12, 13, 14, 15, 16, 17, 18, 19 or 20 percent.

The J polynucleotide in formula (I) may thus, in certain embodiments, comprise a nucleotide sequence having a length that is the same or similar to that of the length of a typical naturally occurring J gene and may, but need not, include a nucleotide sequence that encodes the CDR3 region, as discussed above.

Genomic sequences for TCR and BCR J region genes of humans and other species are known and available from public databases such as Genbank; J region gene sequences include polynucleotide sequences that encode the products of expressed and unexpressed rearranged TCR and BCR genes. The diverse J polynucleotide sequences that may be incorporated into the presently disclosed templates of general formula (I) may vary widely in length, in nucleotide composition (e.g., GC content), and in actual linear polynucleotide sequence.

Alternatives to the V and J sequences described herein, for use in construction of the herein described template oligonucleotides and/or V-segment and J-segment oligonucleotide primers, may be selected by a skilled person based on the present disclosure using knowledge in the art regarding published gene sequences for the V- and J-encoding regions of the genes for each TCR and Ig subunit. Reference Genbank entries for human adaptive immune receptor sequences include: TCRα: (TCRA/D): NC_000014.8 (chr14:22090057.23021075); TCRβ: (TCRB): NC_000007.13 (chr7:141998851.142510972); TCRγ: (TCRG): NC_000007.13 (chr7:38279625.38407656); immunoglobulin heavy chain, IgH (IGH): NC_000014.8 (chr14: 106032614.107288051); immunoglobulin light chain-kappa, IgLκ (IGK): NC_000002.11 (chr2: 89156874.90274235); and immunoglobulin light chain-lambda, IgLλ (IGL): NC_000022.10 (chr22: 22380474.23265085). Reference Genbank entries for mouse adaptive immune receptor loci sequences include: TCRβ: (TCRB): NC_000072.5 (chr6: 40841295.41508370), and immunoglobulin heavy chain, IgH (IGH): NC_000078.5 (chr12:114496979.117248165).

Template and primer design analyses and target site selection considerations can be performed, for example, using the OLIGO primer analysis software and/or the BLASTN 2.0.5 algorithm software (Altschul et al., *Nucleic Acids Res.* 1997, 25(17):3389-402), or other similar programs available in the art.

Accordingly, based on the present disclosure and in view of these known adaptive immune receptor gene sequences and oligonucleotide design methodologies, for inclusion in the instant template oligonucleotides those skilled in the art can design a plurality of V region-specific and J region-specific polynucleotide sequences that each independently contain oligonucleotide sequences that are unique to a given V and J gene, respectively. Similarly, from the present disclosure and in view of known adaptive immune receptor sequences, those skilled in the art can also design a primer set comprising a plurality of V region-specific and J region-specific oligonucleotide primers that are each independently capable of annealing to a specific sequence that is unique to a given V and J gene, respectively, whereby the plurality of primers is capable of amplifying substantially all V genes and substantially all J genes in a given adaptive immune receptor-encoding locus (e.g., a human TCR or IgH locus). Such primer sets permit generation, in multiplexed (e.g., using multiple forward and reverse primer pairs) PCR, of amplification products that have a first end that is encoded by a rearranged V region-encoding gene segment and a second end that is encoded by a J region-encoding gene segment.

Typically and in certain embodiments, such amplification products may include a CDR3-encoding sequence although the invention is not intended to be so limited and contemplates amplification products that do not include a CDR3-encoding sequence. The primers may be preferably designed to yield amplification products having sufficient portions of V and J sequences and/or of V-J barcode (B) sequences as described herein, such that by sequencing the products (amplicons), it is possible to identify on the basis of sequences that are unique to each gene segment (i) the particular V gene, and (ii) the particular J gene in the proximity of which the V gene underwent rearrangement to yield a functional adaptive immune receptor-encoding gene. Typically, and in preferred embodiments, the PCR amplification products will not be more than 600 base pairs in size, which according to non-limiting theory will exclude amplification products from non-rearranged adaptive immune receptor genes. In certain other preferred embodiments the amplification products will not be more than 500, 400, 300, 250, 200, 150, 125, 100, 90, 80, 70, 60, 50, 40, 30 or 20 base pairs in size, such as may advantageously provide rapid, high-throughput quantification of sequence-distinct amplicons by short sequence reads.

In certain preferred embodiments, the plurality of template oligonucleotides comprises at least one template oligonucleotide having an oligonucleotide sequence of general formula (I) to which each V-segment oligonucleotide primer can hybridize, preferably specifically hybridize, and at least one template oligonucleotide having an oligonucleotide sequence of general formula (I) to which each J-segment oligonucleotide primer can hybridize, preferably specifically hybridize.

In certain embodiments the plurality of template oligonucleotides comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51-100, 101-200, 201-300, 301-400, 401-500, 501-600, 601-700, 701-800, 801-900, 901-1000, 1001-1100, 1101-1200, 1201-1300, 1301-1400, 1401-1500, 1501-1600, 1601-1700, 1701-2000, or 2001-2500 unique oligonucleotide sequences.

In certain embodiments the composition comprises at least one template oligonucleotide for each unique V polynucleotide and at least one template oligonucleotide for each unique J polynucleotide. It will be appreciated that because the template oligonucleotides have a plurality of oligonucleotide sequences of general formula (I), which includes a V polynucleotide and which also includes a J polynucleotide, that the template composition may thus comprise fewer than (a×b) unique oligonucleotide sequences, but will in certain embodiments comprise at least the larger of a or b unique oligonucleotide sequences.

Accordingly, the composition may accommodate at least one occurrence of each unique V polynucleotide sequence and at least one occurrence of each unique J polynucleotide sequence, where in some instances the at least one occurrence of a particular unique V polynucleotide will be present in the same template oligonucleotide in which may be found the at least one occurrence of a particular unique J polynucleotide. Thus, for example, "at least one template oligonucleotide for each unique V polynucleotide and at least one template oligonucleotide for each unique J polynucleotide" may in certain instances refer to a single template oligonucleotide in which one unique V polynucleotide and one unique J polynucleotide are present.

As also disclosed elsewhere herein, in certain other preferred embodiments the template composition comprises at least one template oligonucleotide to which each oligonucleotide amplification primer in an amplification primer set can anneal. Hence, the composition may comprise fewer than a or b unique sequences, for example, where an amplification primer set may not include a unique primer for every possible V and/or J sequence.

It will be noted that certain embodiments contemplate a template composition for amplification factor determination, wherein the template composition comprises a plurality of template oligonucleotides having a plurality of oligonucleotide sequences of general formula 5'-U1-B1-V-B2-R-B3-J-B4-U2-3' (I) as described herein. According to these and related embodiments and as also described elsewhere herein, the set of oligonucleotide amplification primers that is capable of amplifying productively rearranged DNA may exclude any oligonucleotide primers that specifically hybridize to a V-region pseudogene or orphon or to a J-region pseudogene or orphon. Hence, in such embodiments the template composition will desirably exclude template oligonucleotides of general formula (I) in which unique V oligonucleotide sequences and/or unique J oligonucleotide sequences are sequences that are, respectively, unique to a V-region pseudogene or orphon or to a J-region pseudogene or orphon.

An exemplary TCRB template composition comprising 858 distinct template oligonucleotides is disclosed in the Sequence Listing in SEQ ID NOS:3157-4014. Another exemplary TCRB template composition comprising 871 distinct template oligonucleotides is disclosed in the Sequence Listing in SEQ ID NOS:1-871. Another exemplary TCRB template composition comprising 689 distinct template oligonucleotides is disclosed in the Sequence Listing in SEQ ID NOS:872-1560.

An exemplary TCRG template composition comprising 70 distinct template oligonucleotides is disclosed in the Sequence Listing in SEQ ID NOS:4015-4084. An exemplary TCRG template composition comprising 70 distinct template oligonucleotides is also disclosed in the Sequence Listing in SEQ ID NOS:1561-1630.

An exemplary IGH template composition comprising 1116 distinct template oligonucleotides is disclosed in the Sequence Listing in SEQ ID NOS:4085-5200. An exemplary IGH template composition comprising 1116 distinct template oligonucleotides is also disclosed in the Sequence Listing in SEQ ID NOS:1805-2920.

Also disclosed herein are exemplary sets of V and J polynucleotides for inclusion in the herein described template oligonucleotides having a plurality of oligonucleotide sequences of general formula (I). For TCRB, the plurality of template oligonucleotides may have a plurality of oligonucleotide sequences of general formula (I) in which polynucleotides V and J have the TCRB V and J sequences set forth in at least one set of 68 TCRB V and J SEQ ID NOS, respectively, as set forth in FIG. 5 as TCRB V/J set 1, TCRB V/J set 2, TCRB V/J set 3, TCRB V/J set 4, TCRB V/J set 5, TCRB V/J set 6, TCRB V/J set 7, TCRB V/J set 8, TCRB V/J set 9, TCRB V/J set 10, TCRB V/J set 11, TCRB V/J set 12 and TCRB V/J set 13.

For TCRG, the plurality of template oligonucleotides may have a plurality of oligonucleotide sequences of general formula (I) in which polynucleotides V and J have the TCRG V and J sequences set forth in at least one set of 14 TCRG V and J SEQ ID NOS, respectively, as set forth in FIG. 6 as TCRG V/J set 1, TCRG V/J set 2, TCRG V/J set 3, TCRG V/J set 4 and TCRG V/J set 5.

For IGH, the plurality of template oligonucleotides may have a plurality of oligonucleotide sequences of general formula (I) in which polynucleotides V and J have the IGH V and J sequences set forth in at least one set of 127 IGH V and J SEQ ID NOS, respectively, as set forth in FIG. 7 as IGH V/J set 1, IGH V/J set 2, IGH V/J set 3, IGH V/J set 4, IGH V/J set 5, IGH V/J set 6, IGH V/J set 7, IGH V/J set 8 and IGH V/J set 9.

ADAPTORS. The herein described template oligonucleotides of general formula (I) also may in certain embodiments comprise first (U1) and second (U2) universal adaptor oligonucleotide sequences, or may lack either or both of U1 and U2. U1 thus may comprise either nothing or an oligonucleotide having a sequence that is selected from (i) a first universal adaptor oligonucleotide sequence, and (ii) a first sequencing platform-specific oligonucleotide sequence that is linked to and positioned 5' to a first universal adaptor oligonucleotide sequence, and U2 may comprise either nothing or an oligonucleotide having a sequence that is selected from (i) a second universal adaptor oligonucleotide sequence, and (ii) a second sequencing platform-specific oligonucleotide sequence that is linked to and positioned 5' to a second universal adaptor oligonucleotide sequence.

U1 and/or U2 may, for example, comprise universal adaptor oligonucleotide sequences and/or sequencing platform-specific oligonucleotide sequences that are specific to a single-molecule sequencing technology being employed, for example the HiSeq™ or GeneAnalyzer™-2 (GA-2) systems (Illumina, Inc., San Diego, Calif.) or another suitable sequencing suite of instrumentation, reagents and software. Inclusion of such platform-specific adaptor sequences permits direct quantitative sequencing of the presently described template composition, which comprises a plurality of different template oligonucleotides of general formula (I), using a nucleotide sequencing methodology such as the HiSeq™ or GA2 or equivalent. This feature therefore advantageously permits qualitative and quantitative characterization of the template composition.

In particular, the ability to sequence all components of the template composition directly allows for verification that each template oligonucleotide in the plurality of template oligonucleotides is present in a substantially equimolar amount. For example, a set of the presently described template oligonucleotides may be generated that have universal adaptor sequences at both ends, so that the adaptor sequences can be used to further incorporate sequencing platform-specific oligonucleotides at each end of each template.

Without wishing to be bound by theory, platform-specific oligonucleotides may be added onto the ends of such modified templates using 5' (5'-platform sequence-universal adaptor-1 sequence-3') and 3' (5'-platform sequence-universal adaptor-2 sequence-3') oligonucleotides in as little as two cycles of denaturation, annealing and extension, so that the relative representation in the template composition of each of the component template oligonucleotides is not quantitatively altered. Unique identifier sequences (e.g., barcode sequences B comprising unique V and B oligonucleotide sequences that are associated with and thus identify, respectively, individual V and J regions, as described herein) are placed adjacent to the adaptor sequences, thus permitting quantitative sequencing in short sequence reads, in order to characterize the template population by the criterion of the relative amount of each unique template sequence that is present.

Where such direct quantitative sequencing indicates that one or more particular oligonucleotides may be over- or underrepresented in a preparation of the template composition, adjustment of the template composition can be made accordingly to obtain a template composition in which all oligonucleotides are present in substantially equimolar amounts. The template composition in which all oligonucleotides are present in substantially equimolar amounts may then be used as a calibration standard for amplification primer sets, such as in the presently disclosed methods for determining and correcting non-uniform amplification potential among members of a primer set.

In addition to adaptor sequences described in the Examples and included in the exemplary template sequences in the Sequence Listing (e.g., at the 5' and 3' ends of SEQ ID NOS:1-1630), other oligonucleotide sequences that may be used as universal adaptor sequences will be known to those familiar with the art in view of the present disclosure, including selection of adaptor oligonucleotide sequences that are distinct from sequences found in other portions of the herein described templates. Non-limiting examples of additional adaptor sequences are shown in Table 3 and set forth in SEQ ID NOS:1710-1731.

TABLE 3

Exemplary Adaptor Sequences

| Adaptor(primer) name | Sequence | SEQ ID NO: |
|---|---|---|
| T7 Promoter | AATACGACTCACTATAGG | 1710 |
| T7 Terminator | GCTAGTTATTGCTCAGCGG | 1711 |
| T3 | ATTAACCCTCACTAAAGG | 1712 |
| SP6 | GATTTAGGTGACACTATAG | 1713 |
| M13F(-21) | TGTAAAACGACGGCCAGT | 1714 |
| M13F(-40) | GTTTTCCCAGTCACGAC | 1715 |
| M13R Reverse | CAGGAAACAGCTATGACC | 1716 |
| AOX1 Forward | GACTGGTTCCAATTGACAAGC | 1717 |
| AOX1 Reverse | GCAAATGGCATTCTGACATCC | 1718 |
| pGEX Forward (GST 5, pGEX 5') | GGGCTGGCAAGCCACGTTTGGTG | 1719 |
| pGEX Reverse (GST 3, pGEX 3') | CCGGGAGCTGCATGTGTCAGAGG | 1720 |
| BGH Reverse | AACTAGAAGGCACAGTCGAGGC | 1721 |
| GFP (C' terminal, CFP, YFP or BFP) | CACTCTCGGCATGGACGAGC | 1722 |
| GFP Reverse | TGGTGCAGATGAACTTCAGG | 1723 |
| GAG | GTTCGACCCCGCCTCGATCC | 1724 |
| GAG Reverse | TGACACACATTCCACAGGGTC | 1725 |
| CYC1 Reverse | GCGTGAATGTAAGCGTGAC | 1726 |
| pFastBacF | 5'-d(GGATTATTCATACCGTCCCA)-3' | 1727 |
| pFastBacR | 5'-d(CAAATGTGGTATGGCTGATT)-3' | 1728 |
| pBAD Forward | 5'-d(ATGCCATAGCATTTTTATCC)-3' | 1729 |
| pBAD Reverse | 5'-d(GATTTAATCTGTATCAGG)-3' | 1730 |
| CMV-Forward | 5'-d(CGCAAATGGGCGGTAGGCGTG)-3' | 1731 |

BARCODES. As described herein, certain embodiments contemplate designing the template oligonucleotide sequences to contain short signature sequences that permit unambiguous identification of the template sequence, and hence of at least one primer responsible for amplifying that template, without having to sequence the entire amplification product. In the herein described template oligonucleotides of general formula (I), B1, B2, B3, and B4 are each independently either nothing or each comprises an oligonucleotide B that comprises an oligonucleotide barcode sequence of 3, 4, 5, 6, 7, 8, 9, 10, 11, 12, 13, 14, 15, 16, 17, 18, 19, 20, 25, 30, 35, 40, 45, 50, 60, 70, 80, 90, 100, 200, 300, 400, 500, 600, 700, 800, 900 or 1000 or more contiguous nucleotides (including all integer values therebetween), wherein in each of the plurality of template oligonucleotide sequences B comprises a unique oligonucleotide sequence that uniquely identifies, as a paired combination, (i) the unique V oligonucleotide sequence of the template oligonucleotide and (ii) the unique J oligonucleotide sequence of the template oligonucleotide.

Thus, for instance, template oligonucleotides having barcode identifier sequences may permit relatively short amplification product sequence reads, such as barcode sequence reads of no more than 1000, 900, 800, 700, 600, 500, 400, 300, 200, 100, 90, 80, 70, 60, 55, 50, 45, 40, 35, 30, 25, 20, 19, 18, 17, 16, 15, 14, 13, 12, 11, 10, 9, 8, 7, 6, 5, 4 or fewer nucleotides, followed by matching this barcode sequence information to the associated V and J sequences that are incorporated into the template having the barcode as part of the template design. By this approach, a large number of amplification products can be simultaneously partially sequenced by high throughput parallel sequencing, to identify primers that are responsible for amplification bias in a complex primer set.

Exemplary barcodes may comprise a first barcode oligonucleotide of 5, 6, 7, 8, 9, 10, 11, 12, 13, 14, 15 or 16 nucleotides that uniquely identifies each V polynucleotide in the template and a second barcode oligonucleotide of 5, 6, 7, 8, 9, 10, 11, 12, 13, 14, 15 or 16 nucleotides that uniquely identifies each J polynucleotide in the template, to provide barcodes of, respectively, 10, 11, 12, 13, 14, 15, 16, 17, 18, 19, 20, 21, 22, 23, 24, 25, 26, 27, 28, 29, 30, 31 or 32 nucleotides in length, but these and related embodiments are not intended to be so limited. Barcode oligonucleotides may comprise oligonucleotide sequences of any length, so long as a minimum barcode length is obtained that precludes occurrence of a given barcode sequence in two or more template oligonucleotides having otherwise distinct sequences (e.g., V and J sequences).

Thus, the minimum barcode length, to avoid such redundancy amongst the barcodes that are used to uniquely identify different V-J sequence pairings, is X nucleotides, where $4^x$ is greater than the number of distinct template species that are to be differentiated on the basis of having non-identical sequences. For example, for the set of 871 template oligonucleotides set forth herein as SEQ ID NOS: 1-871, the minimum barcode length would be five nucleotides, which would permit a theoretical total of 1024 (i.e., greater than 871) different possible pentanucleotide sequences. In practice, barcode oligonucleotide sequence read lengths may be limited only by the sequence read-length limits of the nucleotide sequencing instrument to be employed. For certain embodiments, different barcode oligonucleotides that will distinguish individual species of template oligonucleotides should have at least two nucleotide mismatches (e.g., a minimum hamming distance of 2) when aligned to maximize the number of nucleotides that match at particular positions in the barcode oligonucleotide sequences.

In preferred embodiments, for each distinct template oligonucleotide species having a unique sequence within the template composition of general formula (I), B1, B2, B3, and B4 will be identical.

The skilled artisan will be familiar with the design, synthesis, and incorporation into a larger oligonucleotide or polynucleotide construct, of oligonucleotide barcode sequences of, for instance, at least 3, 4, 5, 6, 7, 8, 9, 10, 11, 12, 13, 14, 15, 16, 17, 18, 19, 20, 21, 22, 23, 24, 25, 30, 35, 40, 45, 50, 55, 60, 70, 80, 90, 100, 200, 300, 300, 500 or more contiguous nucleotides, including all integer values therebetween. For non-limiting examples of the design and implementation of oligonucleotide barcode sequence identification strategies, see, e.g., de Carcer et al., 2011 Adv. Env. Microbiol. 77:6310; Parameswaran et al., 2007 Nucl. Ac. Res. 35(19):330; Roh et al., 2010 Trends Biotechnol. 28:291.

Typically, barcodes are placed in templates at locations where they are not found naturally, i.e., barcodes comprise nucleotide sequences that are distinct from any naturally occurring oligonucleotide sequences that may be found in the vicinity of the sequences adjacent to which the barcodes are situated (e.g., V and/or J sequences). Such barcode sequences may be included, according to certain embodiments described herein, as elements B1, B2 and/or B3 of the presently disclosed template oligonucleotide of general formula (I). Accordingly, certain of the herein described template oligonucleotides of general formula (I) may also in certain embodiments comprise one, two or all three of barcodes B1, B2 and B3, while in certain other embodiments some or all of these barcodes may be absent. In certain embodiments all barcode sequences will have identical or similar GC content (e.g., differing in GC content by no more than 20%, or by no more than 19, 18, 17, 16, 15, 14, 13, 12, 11 or 10%).

In the template compositions according to certain herein disclosed embodiments the barcode-containing element B (e.g., B1, B2, B3, and/or B4) comprises the oligonucleotide sequence that uniquely identifies a single paired V-J combination. Optionally and in certain embodiments the barcode-containing element B may also include a random nucleotide, or a random polynucleotide sequence of at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 70, 80, 90, 100, 200, 300, 300, 500 or more contiguous nucleotides, situated upstream and/or downstream of the specific barcode sequence that uniquely identifies each specific paired V-J combination. When present both upstream and downstream of the specific barcode sequence, the random nucleotide or random polynucleotide sequence are independent of one another, that is, they may but need not comprise the same nucleotide or the same polynucleotide sequence.

RESTRICTION ENZYME SITES. According to certain embodiments disclosed herein, the template oligonucleotide may comprise a restriction endonuclease (RE) recognition site that is situated between the V and J sequences and does not occur elsewhere in the template oligonucleotide sequence. The RE recognition site may optionally be adjacent to a barcode site that identifies the V region sequence. The RE site may be included for any of a number of purposes, including without limitation as a structural feature that may be exploited to destroy templates selectively by contacting them with the appropriate restriction enzyme. It may be desirable to degrade the present template oligonucleotides selectively by contacting them with a suitable RE, for example, to remove template oligonucleotides from other compositions into which they may have been deliberately or accidentally introduced. Alternatively, the RE site may be usefully exploited in the course of sequencing template oligonucleotides in the template composition, and/or as a positional sequence marker in a template oligonucleotide sequence regardless of whether or not it is cleaved with a restriction enzyme. An exemplary RE site is the oligonucleotide motif GTCGAC, which is recognized by the restriction enzyme Sal I. A large number of additional restriction enzymes and their respective RE recognition site sequences are known in the art and are available commercially (e.g., New England Biolabs, Beverly, Mass.). These include, for example, EcoRI (GAATTC) and SphI (GCATGC). Those familiar with the art will appreciate that any of a variety of such RE recognition sites may be incorporated into particular embodiments of the presently disclosed template oligonucleotides.

Sequencing

Sequencing may be performed using any of a variety of available high through-put single molecule sequencing machines and systems. Illustrative sequence systems include sequence-by-synthesis systems such as the Illumina Genome Analyzer and associated instruments (Illumina, Inc., San Diego, Calif.), Helicos Genetic Analysis System (Helicos BioSciences Corp., Cambridge, Mass.), Pacific Biosciences PacBio RS (Pacific Biosciences, Menlo Park, Calif.), or other systems having similar capabilities. Sequencing is achieved using a set of sequencing oligonucleotides that hybridize to a defined region within the amplified DNA molecules. The sequencing oligonucleotides are designed such that the V- and J-encoding gene segments can be uniquely identified by the sequences that are generated, based on the present disclosure and in view of known adaptive immune receptor gene sequences that appear in publicly available databases. See, e.g., U.S. application Ser. No. 13/217,126; U.S. application Ser. No. 12/794,507; PCT/US2011/026373; or PCT/US2011/049012. Exemplary TCRB J-region sequencing primers are set forth in Table 4:

TABLE 4

TCRBJ SEQUENCING PRIMERS

| PRIMER | SEQUENCE | SEQ ID NO: |
|---|---|---|
| >Jseq1-1 | ACAACTGTGAGTCTGGTGCCTTGTCCAAAGAAA | 1696 |
| >Jseq1-2 | ACAACGGTTAACCTGGTCCCCGAACCGAAGGTG | 1697 |
| >Jseq1-3 | ACAACAGTGAGCCAACTTCCCTCTCCAAAATAT | 1698 |
| >Jseq1-4 | AAGACAGAGAGCTGGGTTCCACTGCCAAAAAAC | 1699 |
| >Jseq1-5 | AGGATGGAGAGTCGAGTCCCATCACCAAAATGC | 1700 |

TABLE 4-continued

TCRBJ SEQUENCING PRIMERS

| PRIMER | SEQUENCE | SEQ ID NO: |
|---|---|---|
| >Jseq1-6 | GTCACAGTGAGCCTGGTCCCGTTCCCAAAGTGG | 1701 |
| >Jseq2-1 | AGCACGGTGAGCCGTGTCCCTGGCCCGAAGAAC | 1702 |
| >Jseq2-2 | AGTACGGTCAGCCTAGAGCCTTCTCCAAAAAAC | 1703 |
| >Jseq2-3 | AGCACTGTCAGCCGGGTGCCTGGGCCAAAATAC | 1704 |
| >Jseq2-4 | AGCACTGAGAGCCGGGTCCCGGCGCCGAAGTAC | 1705 |
| >Jseq2-5 | AGCACCAGGAGCCGCGTGCCTGGCCCGAAGTAC | 1706 |
| >Jseq2-6 | AGCACGGTCAGCCTGCTGCCGGCCCCGAAAGTC | 1707 |
| >Jseq2-7 | GTGACCGTGAGCCTGGTGCCCGGCCCGAAGTAC | 1708 |

In certain embodiments, the amplified J-region encoding gene segments may each have a unique sequence-defined identifier tag of 2, 3, 4, 5, 6, 7, 8, 9, 10 or about 15, 20 or more nucleotides, situated at a defined position relative to a RSS site. For example, a four-base tag may be used, in the Jβ-region encoding segment of amplified TCRβ CDR3-encoding regions, at positions +11 through +14 downstream from the RSS site. However, these and related embodiments need not be so limited and also contemplate other relatively short nucleotide sequence-defined identifier tags that may be detected in J-region encoding gene segments and defined based on their positions relative to an RSS site. These may vary between different adaptive immune receptor encoding loci.

Accordingly, the sequencing oligonucleotides may hybridize adjacent to a four base tag within the amplified J-encoding gene segments at positions+11 through +14 downstream of the RSS site. For example, sequencing oligonucleotides for TCRB may be designed to anneal to a consensus nucleotide motif observed just downstream of this "tag", so that the first four bases of a sequence read will uniquely identify the J-encoding gene segment (see, e.g., WO/2012/027503).

The average length of the CDR3-encoding region, for the TCR, defined as the nucleotides encoding the TCR polypeptide between the second conserved cysteine of the V segment and the conserved phenylalanine of the J segment, is 35+/−3 nucleotides. Accordingly and in certain embodiments, PCR amplification using V-segment oligonucleotide primers with J-segment oligonucleotide primers that start from the J segment tag of a particular TCR or IgH J region (e.g., TCR Jβ, TCR Jγ or IgH JH as described herein) will nearly always capture the complete V-D-J junction in a 50 base pair read. The average length of the IgH CDR3 region, defined as the nucleotides between the conserved cysteine in the V segment and the conserved phenylalanine in the J segment, is less constrained than at the TCRβ locus, but will typically be between about 10 and about 70 nucleotides. Accordingly and in certain embodiments, PCR amplification using V-segment oligonucleotide primers with J-segment oligonucleotide primers that start from the IgH J segment tag will capture the complete V-D-J junction in a 100 base pair read.

PCR primers that anneal to and support polynucleotide extension on mismatched template sequences are referred to as promiscuous primers. In certain embodiments, the TCR and Ig J-segment reverse PCR primers may be designed to minimize overlap with the sequencing oligonucleotides, in order to minimize promiscuous priming in the context of multiplex PCR. In one embodiment, the TCR and Ig J-segment reverse primers may be anchored at the 3' end by annealing to the consensus splice site motif, with minimal overlap of the sequencing primers. Generally, the TCR and Ig V and J-segment primers may be selected to operate in PCR at consistent annealing temperatures using known sequence/primer design and analysis programs under default parameters.

For the sequencing reaction, the exemplary IGHJ sequencing primers extend three nucleotides across the conserved CAG sequences as described in WO/2012/027503.

Amplification Factor Determination

Certain embodiments contemplate use of the herein described synthetic template compositions to determine amplification factors for estimating the number of rearranged adaptive immune receptor encoding sequences in a sample. These and related embodiments may find use to quantify the number of adaptive immune receptor encoding sequences in a DNA sample that has been obtained from lymphoid cells, including lymphoid cells that are present in a mixture of cells that comprises cells in which DNA encoding an adaptive immune receptor has undergone DNA rearrangement, but where the sample also contains DNA from cells in which no such rearrangement has taken place (e.g., non-lymphoid cells, immature lymphoid and/or non-lymphoid cells, mesenchymal cells, cancer cells, etc.).

The total number of different members of a given class of adaptive immune receptors (e.g., TCRs or IGs) in a subject may be estimated by multiplexed PCR using a comprehensive V-J amplification primer set followed by quantitative sequencing of amplification products. Multiplexed amplification and high throughput sequencing of rearranged TCR and BCR (IG) encoding DNA sequences are described, for example, in Robins et al., 2009 Blood 114, 4099; Robins et al., 2010 Sci. Translat. Med. 2:47ra64; Robins et al., 2011 J. Immunol. Meth. doi:10.1016/j.jim.2011.09. 001; Sherwood et al. 2011 Sci. Translat. Med. 3:90ra61; U.S. application Ser. No. 13/217,126 (US Pub. No. 2012/0058902), U.S. application Ser. No. 12/794,507 (US Pub. No. 2010/0330571), WO/2010/151416, WO/2011/106738 (PCT/US2011/026373), WO2012/027503 (PCT/US2011/049012), U.S. Application No. 61/550,311, and U.S. Application No. 61/569,118.

This methodology typically involves sampling DNA from a subpopulation of lymphoid cells, such as lymphoid cells that are present in a blood sample, which is known also to contain nucleated cells that lack rearranged TCR or IG encoding DNA. The present compositions and methods may permit improved accuracy and precision in the determination of the number of rearranged TCR and IG encoding DNA molecules in such a sample. As described herein, for instance, by "spiking" (adding into) the DNA sample with the present template composition, an internal amplification template standard is provided for assessing the relative efficiencies across the range of oligonucleotide primers that are present in the multiplexed amplification primer set. By so assessing the amplification products of the present artificial template composition, which is added to the amplification reaction in known amounts, an amplification factor (e.g., a multiplicative, normalizing, scaling or geometric factor, etc.) can be determined for the oligonucleotide amplification primer set and can then be used to calculate the number of natural DNA templates in the sample.

As another example, these and related embodiments permit quantification of Minimal Residual Disease (MRD) in lymphoma or leukemia, by quantitative detection of rearranged TCR or IG encoding DNA in samples obtained from mixed preparations of lymphoid and non-lymphoid cells, including persistent lymphoma or leukemia cells. Prior methods determine MRD as the number of malignant cells that are detectable as a proportion of the total number of cells in a sample. In contrast, the present methods permit estimation of the total number of cells in a sample that have rearranged TCR or IG encoding DNA, so that malignant cells (e.g., those having a particular TCR or IG rearrangement, such as a clonotype) can be quantified as a proportion of such rearranged cells instead of as a proportion of all cells. By way of non-limiting theory, it is believed that because the representation of all rearranged cells in a clinical sample from a subject having or suspected of having MRD is typically very low, the present methods will dramatically improve the sensitivity with which MRD can be detected, including improving such sensitivity by increasing the signal-to-noise ratio.

Accordingly certain embodiments thus provide a method for quantifying rearranged DNA molecules encoding one or a plurality of adaptive immune receptors in a biological sample that comprises DNA from lymphoid cells of a subject, each adaptive immune receptor comprising a variable region and a joining region. Briefly, the method comprises the steps of:

(A) in a multiplexed amplification reaction using the herein described oligonucleotide amplification primer set that is capable of amplifying substantially all V-J encoding combinations for a given adaptive immune receptor, amplifying DNA from the sample to which has been added a known amount of the herein described template composition for amplification factor determination, to obtain amplification products;

(B) quantitatively sequencing the amplification products of (A) to quantify (i) template amplification products, which are amplification products of the herein described template composition and will be identifiable because they contain at least one barcode oligonucleotide sequence, and (ii) amplification products of rearranged adaptive immune receptor encoding DNA sequences in the sample, which will be identifiable because they contain specific V and J sequences but lack an oligonucleotide barcode sequence;

(C) calculating an amplification factor based on quantitative information obtained in step (B); and (D) using the amplification factor of (C) to determine, by calculation, the number of unique adaptive immune receptor encoding DNA molecules in the sample.

Without wishing to be bound by theory, according to these and related methods, the number of rearranged TCR or IG encoding DNA molecules that are sampled in a multiplexed amplification reaction is measured. To do so, a sequence coverage value, e.g., the number of output sequence reads that are determined for each input (template) molecule, is determined and averaged across the entire number of different template oligonucleotides that are present, to obtain an average sequence coverage value. By dividing (i) the number of reads that are obtained for a given sequence by (ii) the average sequence coverage value, the number of rearranged molecules that are present as templates at the start of the amplification reaction can be calculated.

Thus, for example, to calculate the sequence coverage value, a known quantity of a set of synthetic molecules of the presently disclosed template composition is added to each PCR amplification, the synthetic templates having the basic structure of formula (I) 5' U-B1-V-B2-R-(B3)-J-B4-U 3' where each V is a 300 base pair segment having a sequence that matches a TCR or IG V gene sequence and J is a 100 base pair segment having a sequence that matches a TCR or IG J gene. B2 is a unique barcode oligonucleotide sequence that uniquely identifies each VJ pair and that also differentiates amplification products of the synthetic DNA templates (which will contain the barcode sequence) from amplification products of naturally occurring biologic template DNA molecules that are contributed by the lymphoid DNA sample (which will lack the barcode sequence). In this example, B3 of formula (I) is nothing. After PCR amplification and sequencing, the numbers of each sequenced synthetic molecule (i.e., amplification products containing the barcode sequence) are counted. The sequence coverage of the synthetic molecules is then calculated based on the known number of starting synthetic template molecules used to spike the amplification reaction.

For example, a pool of 5000 synthetic, barcode-containing template molecules comprising 4-5 copies each of 1100 unique synthetic template oligonucleotide sequences (representing every possible VJ pair) may be added to the amplification reaction. If the amplification products include 50,000 sequences that match the synthetic template molecules, a sequence coverage value of 10× has been obtained and the amplification factor is 10. To estimate the number of natural VDJ-rearranged template molecules in the DNA obtained from the sample, the number of amplification products of the natural templates (i.e., amplification products that lack any barcode sequence) is then divided by the amplification factor. For added accuracy, because in this example the 5000 synthetic molecules are a complex pool of 1100 molecules representing every VJ pair, the amplification factor for every VJ pair can be individually calculated. The amplification factor can then be averaged across all of the synthetic molecules (FIG. 7). The accuracy and robustness of the method are shown in FIG. 8 and details are described below in Example 2.

Accordingly, in these embodiments the method comprises:

(A) amplifying DNA in a multiplex polymerase chain reaction (PCR) that comprises: (1) DNA from the biological sample that comprises lymphoid cells of the subject, (2) the template composition for amplification factor determination of general formula (I) as described herein, in which a known number of each of the plurality of template oligonucleotides having a unique oligonucleotide sequence is present, (3) an oligonucleotide amplification primer set that is capable of amplifying rearranged DNA encoding one or a plurality of adaptive immune receptors in the DNA from the biological sample, the primer set comprising: (a) in substantially equimolar amounts, a plurality of V-segment oligonucleotide primers that are each independently capable of specifically hybridizing to at least one polynucleotide encoding an adaptive immune receptor V-region polypeptide or to the complement thereof, wherein each V-segment primer comprises a nucleotide sequence of at least 15 contiguous nucleotides that is complementary to at least one functional adaptive immune receptor V region-encoding gene segment and wherein the plurality of V-segment primers specifically hybridize to substantially all functional adaptive immune receptor V region-encoding gene segments that are present in the template composition, and (b) in substantially equimolar amounts, a plurality of J-segment oligonucleotide primers that are each independently capable of specifically hybridizing to at least one polynucleotide encoding an adaptive immune receptor J-region polypeptide or to the complement thereof, wherein each J-segment primer comprises a nucleotide sequence of at least 15 contiguous nucleotides that is complementary to at least one functional adaptive immune receptor J region-encoding gene segment and wherein the plurality of J-segment primers specifically hybridize to substantially all functional adaptive immune receptor J region-encoding gene segments that are present in the template composition, wherein the V-segment and J-segment oligonucleotide primers are capable of promoting amplification in said multiplex polymerase chain reaction (PCR) of (i) substantially all template oligonucleotides in the template composition to produce a multiplicity of amplified template DNA molecules, said multiplicity of amplified template DNA molecules being sufficient to quantify diversity of the template oligonucleotides in the template composition, and (ii) substantially all rearranged DNA molecules encoding adaptive immune receptors in the biological sample to produce a multiplicity of amplified rearranged DNA molecules, said multiplicity of amplified rearranged DNA molecules being sufficient to quantify diversity of the rearranged DNA molecules in the DNA from the biological sample, and wherein each amplified DNA molecule in the multiplicity of amplified template DNA molecules and in the multiplicity of amplified rearranged DNA molecules is less than 1000, 900, 800, 700, 600, 500, 400, 300, 200, 100, 90, 80 or 70 nucleotides in length;

(B) quantitatively sequencing all or a sufficient portion of each of said amplified template DNA molecules and each of said amplified rearranged DNA molecules to quantify (i) a template product number of amplified template DNA molecules which contain at least one oligonucleotide barcode sequence, and (ii) a rearranged product number of amplified rearranged DNA molecules which lack an oligonucleotide barcode sequence;

(C) calculating an amplification factor by dividing the template product number of (B)(i) by the known number of each of the plurality of template oligonucleotides having a unique oligonucleotide sequence of (A)(2); and (D) dividing the rearranged product number of (B)(ii) by the amplification factor calculated in (C) to quantify unique adaptive immune receptor encoding DNA molecules in the sample.

The contemplated embodiments are not intended to be limited to the above described method, such that from the present disclosure the skilled person will appreciate variations that may be employed. An alternative approach, for example, may not use the herein described synthetic template composition as a spiked-in control template in multiplexed PCR amplification of a DNA sample that contains rearranged lymphoid cell TCR and/or IG encoding DNA as well as non-rearranged DNA. Instead, according to one such alternative, to the amplification reaction using V and J amplification primers may be added a known set of oligonucleotide amplification primers that amplify a distinct, highly conserved genomic sequence region. These genomic control primers may amplify every genome that is present in the DNA sample regardless of whether or not it contains rearranged TCR and/or IG encoding sequences, whereas the V and J primers may amplify products only from genomes with a rearranged VDJ region. The ratio between these two classes of amplification product molecules permits estimation of the total number of B cell genomes in the sample.

It is further contemplated for these and related embodiments of any of the herein described methods that such a method may further comprise sequencing the amplified adaptive immune receptor encoding DNA molecules that are produced. Compositions and methods for the sequencing of rearranged adaptive immune receptor gene sequences and for adaptive immune receptor clonotype determination are described in Robins et al., 2009 *Blood* 114, 4099; Robins et al., 2010 *Sci. Translat. Med.* 2:47ra64; Robins et al., 2011 *J. Immunol. Meth.* doi:10.1016/j.jim.2011.09. 001; Sherwood et al. 2011 *Sci. Translat. Med.* 3:90ra61; U.S. application Ser. No. 13/217,126 (US Pub. No. 2012/0058902), U.S. application Ser. No. 12/794,507 (US Pub. No. 2010/0330571), WO/2010/151416, WO/2011/106738 (PCT/US2011/026373), WO2012/027503 (PCT/US2011/049012), U.S. Application No. 61/550,311, and U.S. Application No. 61/569,118, herein incorporated by reference. Therein can also be found details regarding sequencing PCR amplification products, processing sequencing data, and uses of measurements of adaptive immune receptor diversity, all of which which may be employed for use according to the methods described herein.

According to non-limiting theory, these embodiments exploit current understanding in the art (also described above) that once an adaptive immune cell (e.g., a T or B lymphocyte) has rearranged its adaptive immune receptor-encoding (e.g., TCR or Ig) genes, its progeny cells possess the same adaptive immune receptor-encoding gene rearrangement, thus giving rise to a clonal population that can be uniquely identified by the presence therein of rearranged CDR3-encoding V- and J-gene segments that may be amplified by a specific pairwise combination of V- and J-specific oligonucleotide primers as herein disclosed.

The practice of certain embodiments of the present invention will employ, unless indicated specifically to the contrary, conventional methods in microbiology, molecular biology, biochemistry, molecular genetics, cell biology, virology and immunology techniques that are within the skill of the art, and reference to several of which is made below for the purpose of illustration. Such techniques are explained fully in the literature. See, e.g., Sambrook, et al., *Molecular Cloning: A Laboratory Manual* ($3^{rd}$ Edition, 2001); Sambrook, et al., *Molecular Cloning: A Laboratory Manual* ($2^{nd}$ Edition, 1989); Maniatis et al., *Molecular Cloning: A Laboratory Manual* (1982); Ausubel et al., *Current Protocols in Molecular Biology* (John Wiley and Sons, updated July 2008); *Short Protocols in Molecular Biology: A Compendium of Methods from Current Protocols in Molecular Biology*, Greene Pub. Associates and Wiley-Interscience; Glover, *DNA Cloning: A Practical Approach*, vol. I & II (IRL Press, Oxford Univ. Press USA, 1985); *Current Protocols in Immunology* (Edited by: John E. Coligan, Ada M. Kruisbeek, David H. Margulies, Ethan M. Shevach, Warren Strober 2001 John Wiley & Sons, NY, N.Y.); *Real-Time PCR: Current Technology and Applications*, Edited by Julie Logan, Kirstin Edwards and Nick Saunders, 2009, Caister Academic Press, Norfolk, UK; Anand, *Techniques for the Analysis of Complex Genomes*, (Academic Press, New York, 1992); Guthrie and Fink, *Guide to Yeast Genetics and Molecular Biology* (Academic Press, New York, 1991); *Oligonucleotide Synthesis* (N. Gait, Ed., 1984); *Nucleic Acid Hybridization* (B. Hames & S. Higgins, Eds., 1985); *Transcription and Translation* (B. Hames & S. Higgins, Eds., 1984); *Animal Cell Culture* (R. Freshney, Ed., 1986); Perbal, *A Practical Guide to Molecular Cloning* (1984); *Next-Generation Genome Sequencing* (Janitz, 2008 Wiley-VCH); *PCR Protocols* (*Methods in Molecular Biology*) (Park, Ed., $3^{rd}$ Edition, 2010 Humana Press); *Immobilized Cells And Enzymes* (IRL Press, 1986); the treatise, *Methods In Enzymology* (Academic Press, Inc., N.Y.); *Gene Transfer Vectors For Mammalian Cells* (J. H. Miller and M. P. Calos eds., 1987, Cold Spring Harbor Laboratory); Harlow and Lane, *Antibodies*, (Cold Spring Harbor Laboratory Press, Cold Spring Harbor, N.Y., 1998); *Immunochemical Methods In Cell And Molecular Biology* (Mayer and Walker, eds., Academic Press, London, 1987); *Handbook Of Experimental Immunology*, Volumes I-IV (D. M. Weir and CC Blackwell, eds., 1986); Riott, *Essential Immunology*, 6th Edition, (Blackwell Scientific Publications, Oxford, 1988); *Embryonic Stem Cells: Methods and Protocols* (Methods in Molecular Biology) (Kurstad Turksen, Ed., 2002); *Embryonic Stem Cell Protocols: Volume I: Isolation and Characterization* (Methods in Molecular Biology) (Kurstad Turksen, Ed., 2006); *Embryonic Stem Cell Protocols: Volume II: Differentiation Models* (Methods in Molecular Biology) (Kurstad Turksen, Ed., 2006); *Human Embryonic Stem Cell Protocols* (Methods in Molecular Biology) (Kursad Turksen Ed., 2006); *Mesenchymal Stem Cells: Methods and Protocols* (Methods in Molecular Biology) (Darwin J. Prockop, Donald G. Phinney, and Bruce A. Bunnell Eds., 2008); *Hematopoietic Stem Cell Protocols* (Methods in Molecular Medicine) (Christopher A. Klug, and Craig T. Jordan Eds., 2001); *Hematopoietic Stem Cell Protocols* (Methods in Molecular Biology) (Kevin D. Bunting Ed., 2008) *Neural Stem Cells: Methods and Protocols* (Methods in Molecular Biology) (Leslie P. Weiner Ed., 2008).

Unless specific definitions are provided, the nomenclature utilized in connection with, and the laboratory procedures and techniques of, molecular biology, analytical chemistry, synthetic organic chemistry, and medicinal and pharmaceutical chemistry described herein are those well known and commonly used in the art. Standard techniques may be used for recombinant technology, molecular biological, microbiological, chemical syntheses, chemical analyses, pharmaceutical preparation, formulation, and delivery, and treatment of patients.

Computer System

FIG. 12 is a high-level block diagram illustrating a functional view of a typical computer system 1200, according to an embodiment of the invention. Illustrated are at least one processor 1202 coupled to a bus 1204. Also coupled to the bus 1204 are a memory 1206, a storage device 1208, a keyboard 1210, a graphics adapter 1212, a pointing device 1214, and a network adapter 1216. A display 1218 is coupled to the graphics adapter 1212.

The processor 1202 may be any general-purpose processor such as an INTEL x86, SUN MICROSYSTEMS SPARC, or POWERPC compatible-CPU. The storage device 1208 is, in one embodiment, a hard disk drive but can also be any other device capable of storing data, such as a writeable compact disk (CD) or DVD, or a solid-state memory device. The memory 1206 may be, for example, firmware, read-only memory (ROM), non-volatile random access memory (NVRAM), and/or RAM, and holds instructions and data used by the processor 202. The pointing device 1214 may be a mouse, track ball, or other type of pointing device, and is used in combination with the keyboard 1210 to input data into the computer system 1200. The graphics adapter 1212 displays images and other information on the display 1218. The network adapter 1216 couples the computer system 1200 to the network.

As is known in the art, the computer system 1200 is adapted to execute computer program modules. As used herein, the term "module" refers to computer program logic and/or data for providing the specified functionality. A module can be implemented in hardware, firmware, and/or software. In one embodiment, the modules are stored on the storage device 1208, loaded into the memory 1206, and executed by the processor 1202. The various methods and steps illustrated herein may be executed by the components of the computer system 1200.

Some portions of this description describe the embodiments of the invention in terms of algorithms and symbolic representations of operations on information. These algorithmic descriptions and representations are commonly used by those skilled in the data processing arts to convey the substance of their work effectively to others skilled in the art. These operations, while described functionally, computationally, or logically, are understood to be implemented by computer programs or equivalent electrical circuits, microcode, or the like. Furthermore, it has also proven convenient at times, to refer to these arrangements of operations as modules, without loss of generality. The described operations and their associated modules may be embodied in software, firmware, hardware, or any combinations thereof.

Any of the steps, operations, or processes described herein may be performed or implemented with one or more hardware or software modules, alone or in combination with other devices. In one embodiment, a software module is implemented with a computer program product comprising a computer-readable medium containing computer program code, which can be executed by a computer processor for performing any or all of the steps, operations, or processes described.

Embodiments of the invention may also relate to an apparatus for performing the operations herein. This apparatus may be specially constructed for the required purposes, and/or it may comprise a general-purpose computing device selectively activated or reconfigured by a computer program stored in the computer. Such a computer program may be stored in a tangible computer readable storage medium or any type of media suitable for storing electronic instructions, and coupled to a computer system bus. Furthermore, any computing systems referred to in the specification may include a single processor or may be architectures employing multiple processor designs for increased computing capability.

Embodiments of the invention may also relate to a computer data signal embodied in a carrier wave, where the computer data signal includes any embodiment of a computer program product or other data combination described herein. The computer data signal is a product that is presented in a tangible medium or carrier wave and modulated or otherwise encoded in the carrier wave, which is tangible, and transmitted according to any suitable transmission method.

Additionally, the language used in the specification has been principally selected for readability and instructional purposes, and it may not have been selected to delineate or circumscribe the inventive subject matter. It is therefore intended that the scope of the invention be limited not by this detailed description, but rather by any claims that issue on an application based hereon. Accordingly, the disclosure of the embodiments of the invention is intended to be illustrative, but not limiting, of the scope of the invention.

Unless the context requires otherwise, throughout the present specification and claims, the word "comprise" and variations thereof, such as, "comprises" and "comprising" are to be construed in an open, inclusive sense, that is, as "including, but not limited to". By "consisting of" is meant including, and typically limited to, whatever follows the phrase "consisting of" By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that no other elements are required and may or may not be present depending upon whether or not they affect the activity or action of the listed elements.

In this specification and the appended claims, the singular forms "a," "an" and "the" include plural references unless the content clearly dictates otherwise. As used herein, in particular embodiments, the terms "about" or "approximately" when preceding a numerical value indicates the value plus or minus a range of 5%, 6%, 7%, 8% or 9%. In other embodiments, the terms "about" or "approximately" when preceding a numerical value indicates the value plus or minus a range of 10%, 11%, 12%, 13% or 14%. In yet other embodiments, the terms "about" or "approximately" when preceding a numerical value indicates the value plus or minus a range of 15%, 16%, 17%, 18%, 19% or 20%.

Reference throughout this specification to "one embodiment" or "an embodiment" or "an aspect" means that a particular feature, structure or characteristic described in connection with the embodiment is included in at least one embodiment of the present invention. Thus, the appearances of the phrases "in one embodiment" or "in an embodiment" in various places throughout this specification are not necessarily all referring to the same embodiment. Furthermore, the particular features, structures, or characteristics may be combined in any suitable manner in one or more embodiments.

EXAMPLES

Example 1

Characterization of T Cell Clonality and MRD Detection in T-ALL Samples

In this example, paired blood samples of pediatric T-cell acute lymphoblastic leukemia (T-ALL) from 43 patients (Children's Oncology Group AALL0434) were obtained at diagnosis and at day 29 post-induction therapy. The complementarity determining region (CDR3) encoding regions of TCRB and TCRG genes were sequenced for all 86 specimens by high-throughput sequencing (HTS) using an Illumina GA2 platform (Illumina, San Diego, Calif.) as previously described (see Robins et al., *Blood*, 114(19):4099-4107, 2009; and Robins et al., *Sci Transl Med.* 3(90):90ra61, 2011). Pre-treatment samples were used to identify unique rearranged TCR CDR3-encoding DNA sequences for the leukemic clone, and post-treatment samples were assessed for the frequency of each rearranged TCR CDR3-encoding DNA sequence as a percentage of the total. The frequency of each rearranged TCR CDR3-encoding DNA sequence was also enumerated in post-treatment samples from all other patients to evaluate specificity. These results were compared to MRD results obtained by 9-color flow cytometry, per trial protocol.

Thirty-one of 43 pre-treatment samples (72.1%) had a detectable clonal T-cell population based on TCRB sequence analysis, and 27 of these also had a detectable clonal TCRG sequence. Five samples exhibited an additional unique rearranged TCRG CDR3-encoding sequence, consistent either with rearrangement of both TCRG loci or with the presence of two clonal subpopulations. Five of 12 cases without a detectable clonal TCRB gene sequence had the immunophenotype of early thymic precursor (ETP) T-ALL, consistent with their bearing only unrearranged germline TCRB and TCRG genes. No other cases were ETP. Six of the 12 cases without a detectable clonal TCRB gene sequence had the immunophenotype of near early thymic precursor (n-ETP) T-ALL. The remaining sample without a detectable clonal TCRB gene sequence, did have a detectable clonal TCRG gene sequence. By contrast, of the 31 cases in which a clonal TCRB rearrangement was identified at diagnosis, no cases were ETP, three were near-ETP, and the remaining 28 were non-ETP T-ALL immunophenotype. In this cohort, there was an association of the absence of a complete, clonal TCRB sequence in the pre-treatment sample with either ETP or near-ETP immunophenotype by mpFC (p<0.0001, Fischer's exact test).

Figure 1:
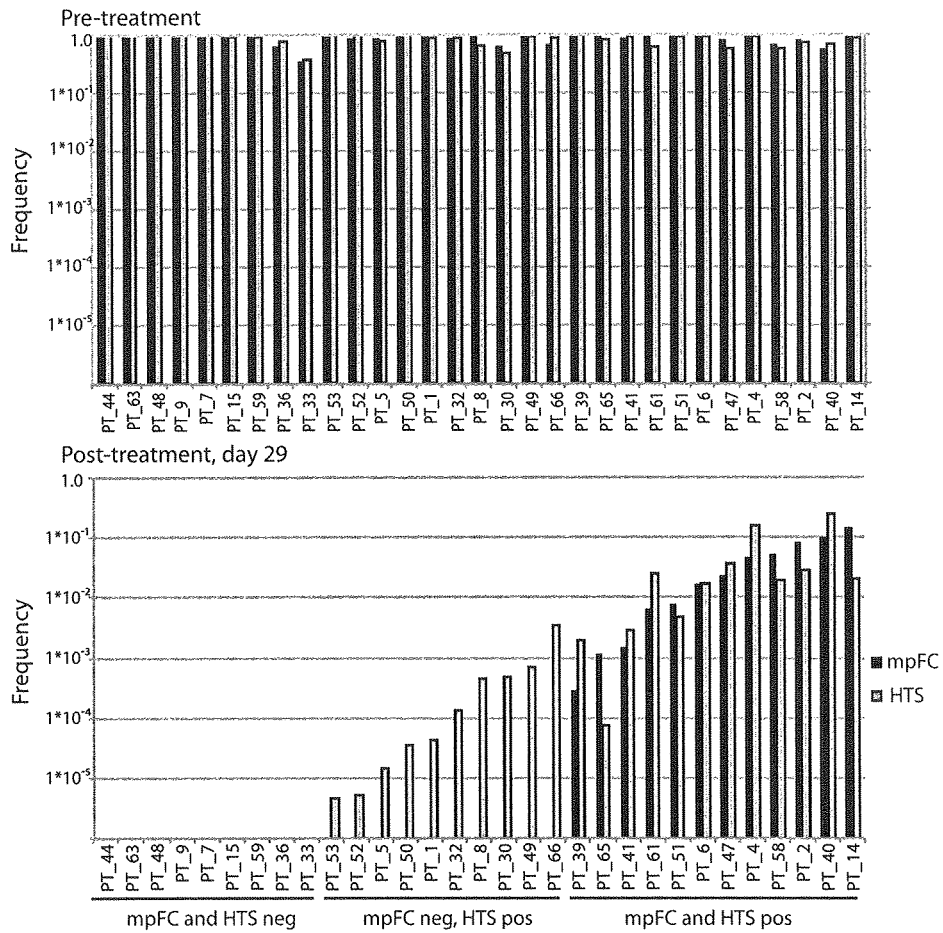
FIG. 1 (FIG. 1A-1B) depicts comparison of T-cell clonality assessment in blood samples from T-ALL patients, by high-throughput sequencing (HTS) and multi-parametric flow cytometry (mpFC), prior to treatment (Day 0) and 29 days after treatment (Day 29). Clones detected by HTS (red) were found in all 12 informative post-treatment samples that were positive for MRD by mpFC (blue), as well as at a lower level in 10 additional patients, suggesting superior sensitivity for HTS versus mpFC. Patients 39 and 52 were near-early thymic precursor (nETP) immunophenotype; all others were typical T-cell acute lymphoblastic leukemia (T-ALL).

The remaining 37 samples with a detectable clonal TCR sequence prior to treatment were used to compare mpFlow with HTS. High-throughput sequencing used to detect the patient's original clonal TCRB sequences at day 29 revealed three sub-groups of patients in this cohort: 1) those for whom MRD was not detected by either HTS or mpFC, 9 cases; 2) those for whom MRD was detected only by HTS but not mpFC, 10 cases; and 3) those in which MRD was detected by both HTS and mpFC, 12 cases (FIG. 1B). Of the ten cases for which HTS did and mpFC did not detect MRD, the MRD was 10 to 100-fold lower than for the 12 cases for which both mpFC and HTS detected MRD. These results suggested that HTS offered superior sensitivity MRD detection. The background sequence frequencies were very low (0-$10^{-5}$) in other patient post-treatment samples, being slightly higher for TCRG than for TCRB, consistent with germline sequence diversity. The strong association of ETP status with the lack of a detectable clonal TCR sequence by HTS at diagnosis also suggested the utility of TCR HTS for identifying this poor outcome subset of T-ALL.

Materials and Methods

Sample preparation. Blood (5 ml samples) was collected prior to treatment (Day 0) and 29 days following initial treatment (Day 29) from 43 individuals diagnosed with T-ALL. Collected blood was subdivided into a sample for TCR high-throughput sequencing (HTS) and a sample for mpFC flow cytometric analysis. Samples were blind-coded and submitted for HTS. All patients provided consent for the use of their samples as part of the COG trial.

Flow cytometry. Multi-parametric, 9-color flow cytometry (mpFC) was performed at the University of Washington (Seattle, Wash.) as part of the routine evaluation for MRD (17). Flow data were reviewed, with samples being classified as early-thymic precursor (ETP), or non-ETP T-ALL, as previously described (15). Cases in which the immunophenotype was similar but not sufficient to meet criteria for ETP were designated as near-ETP (nETP). Data were analyzed using Woodlist software version 2.7 (B. Wood, Univ. of Washington, Seattle, Wash.). Results are reported as lymphoblast percent of total T cells, total mononuclear cells and total cellularity for comparison with molecular studies.

High-throughput sequencing (HTS)/Sequencing CDR3 regions: TCRG and TCRB CDR3 regions were amplified and sequenced from 400 ng of Day 0 and 1200 ng of Day 29 samples, or all remaining sample of extracted DNA. Amplification and sequencing of TCRβ CDR3 regions was carried out as previously described (9) and amplification and sequencing of TCRG CDR3 regions was carried as previously described (11). The sequences for both the TCRβ and TCRγ CDR3 region were delineated according to the definition established by the International ImMunoGeneTics collaboration (18). Sequences that did not match CDR3 sequences were removed from the analysis. A standard algorithm was used to identify which V, D, and J segments contributed to each TCRβ CDR3 sequence and which V and J segments contributed to each TCRγ CDR3 sequence (18). Rearranged CDR3 sequences were classified as non-productive if insertions or deletions that resulted in frame-shifts or premature stop-codons were identified.

Identifying CDR3 sequences: Ten mL of blood were isolated from six healthy controls. Peripheral blood mononuclear cells (PBMC) were isolated, DNA extracted, and 1200 ng of extracted DNA was used to amplify TCRB sequences using the same protocol as the day 29 T-ALL samples. The frequency of the most common αβ T cell reactive clones in PBMC from these healthy individuals averaged 3% of the total repertoire with a standard deviation of 3%. Given that αβ T cells carried both rearranged TCRG and TCRB chain CDR3 encoding sequences (11), both the frequencies of the highest copy TCRB and TCRG CDR3 chains were assumed to represent the neoplastic T lymphoblasts. At day 0, samples with ten-fold higher frequency of the most common CDR3 sequences as compared to controls, >30%, were considered to be the clonal population. For samples in which the two most common TCR sequences were of comparable frequency, both sequences were considered as being the probable cancer clone. MRD at 29 days after treatment was screened by searching for CDR3 sequences that identically matched the clonal sequence identified at day 0, requiring a 60 base pair match. Both the presence and the frequency of the MRD relative to the total TCR repertoire were noted. To determine if the clonal sequence was specific, all day 29 samples were screened for the presence and frequency of all identified clonal TCR CDR3 sequences to determine cross-patient specificity.

Results

Using 43 matched-pairs of T-ALL samples derived from patients enrolled in the Children's Oncology Group AALL0434 trial (University of Washington, Seattle, Wash.), the complementarity determining regions (CDR3) of TCRB (Table 5) and TCRG (Tables 5 and 6) were sequenced by HTS using approximately 75,000 genomes on day 0 and 150,000 genomes on day 29. These day 0 sequences permitted definition, for each patient, of the unique recombined TCR gene sequences representing each patient's clonal, neoplastic T lymphoblasts (Tables 5 and 6). Normalized mpFC (blast/CD7+ cells) data are also shown in Tables 5 and 6.

TABLE 5

% of T cells that were Blasts at Day 0 and Day 29: Characterization by mpFC and HTS of TCRB

| Patient | Day 0 Blast/T cells mpFC | Day 0 TCRB HTS | Day 29 Blast/T cells by mpFC | Day29 TCRB HTS |
|---|---|---|---|---|
| PT_44 | 0.97672065 | 0.99434804 | 0 | 0 |
| PT_63 | 0.971875 | 0.99433591 | 0 | 0 |
| PT_48 | 0.98097252 | 0.98802835 | 0 | 0 |
| PT_9 | 0.97037794 | 0.98506196 | 0 | 0 |
| PT_7 | 0.9726997 | 0.98471692 | 0 | 0 |
| PT_15 | 0.97247706 | 0.96641846 | 0 | 0 |
| PT_59 | 0.92966361 | 0.93608697 | 0 | 0 |
| PT_36 | 0.63565891 | 0.77634724 | 0 | 0 |
| PT_33 | 0.36514523 | 0.38978913 | 0 | 0 |
| PT_53 | 0.96843177 | 0.98636256 | 0 | 4.6305E-06 |
| PT_52 | 0.87757202 | 0.97285037 | 0 | 5.0976E-06 |
| PT_5 | 0.88681319 | 0.80910921 | 0 | 1.4101E-05 |
| PT_50 | 0.98088531 | 0.99470926 | 0 | 3.4997E-05 |
| PT_1 | 0.93128964 | 0.86986261 | 0 | 4.4024E-05 |
| PT_32 | 0.87001287 | 0.89047715 | 0 | 0.00013614 |
| PT_8 | 0.97985901 | 0.63830248 | 0 | 0.0004481 |
| PT_30 | 0.67403315 | 0.48984069 | 0 | 0.00048091 |
| PT_49 | 0.94558522 | 0.93357269 | 0 | 0.00070619 |
| PT_66 | 0.71351351 | 0.86920201 | 0 | 0.00348305 |
| PT_39 | 1 | 0.98803323 | 0.0002907 | 0.00201475 |
| PT_65 | 0.9563795 | 0.84025047 | 0.00114679 | 7.6499E-05 |
| PT_41 | 0.90253807 | 0.92867626 | 0.00152838 | 0.00292659 |
| PT_61 | 0.93349456 | 0.62550401 | 0.00653266 | 0.02535341 |
| PT_51 | 0.95571576 | 0.94895541 | 0.00797546 | 0.0047952 |
| PT_6 | 0.98189135 | 0.95963063 | 0.01690647 | 0.01741715 |
| PT_47 | 0.83670295 | 0.58431047 | 0.02276786 | 0.03573035 |
| PT_4 | 0.99295775 | 0.96190309 | 0.04795737 | 0.1614654 |
| PT_58 | 0.68115942 | 0.58647625 | 0.05369128 | 0.01921525 |
| PT_2 | 0.81477516 | 0.74794199 | 0.08156607 | 0.02893032 |
| PT_40 | 0.5815508 | 0.70912279 | 0.0990566 | 0.2422609 |
| PT_14 | 0.91898148 | 0.88730182 | 0.14479026 | 0.02124786 |
| PT_55 | 0.98183653 | 0.12006615 | 0.43255814 | 0 |
| PT_57 | 0.95523906 | 0.02088572 | 0.6459144 | 0 |
| PT_3 | 0.98694779 | 0.01755708 | 0.00202703 | 0 |
| PT_12 | 0.89263804 | 0.01493205 | 0.05456989 | 0 |
| PT_54 | 0.97082495 | 0.09110046 | 0.069869 | 0.28020422 |
| PT_45 | 0.99296482 | 0.07754443 | 0.2345679 | 0 |
| PT_60 | 0.90118153 | 0.03709322 | 0.05792683 | 0 |
| PT_68 | 0.9874477 | 0.02719658 | 0.00849858 | 0.0424174 |
| PT_56 | 0.86721144 | 0.01765149 | 0.1245283 | 0.0053763 |
| PT_13 | 0.95947426 | 0.06090199 | 0.76954315 | 0 |
| PT_42 | 0.91920252 | 0.08504223 | 0.0019544 | 0.01346556 |
| PT_11 | 0.96177686 | 0.00694597 | 0 | 0 |
| AVG ETP | | | 0.18478833 | |
| AVG other | | | 0.01613064 | |
| AVG All | | | 0.06712017 | |

Figure 2:
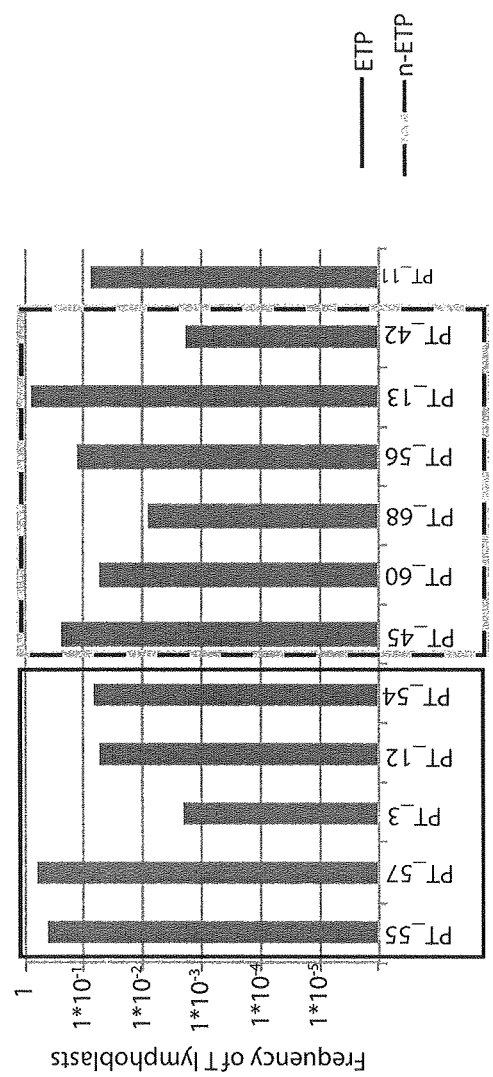
FIG. 2 shows MRD detection in early thymic precursor (ETP) or near-ETP (nETP) cases at day 29. All cases (5/5) designated early-thymic precursor ETP (yellow), and most cases (6/8) designated near-ETP (nETP, green) lacked a clonal, complete TCRB gene rearrangement at day 0, as assessed by HTS of amplified and rearranged TCRβ CDR3-encoding DNA regions. These cases, however, had MRD detectable by mpFC.
Figure 3:
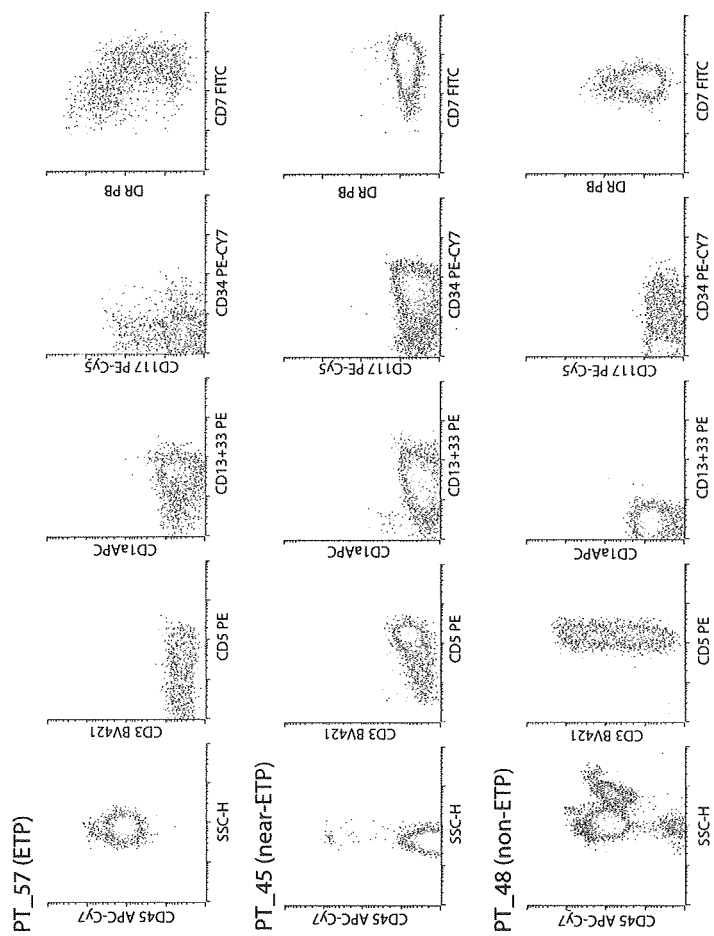
FIG. 3 shows representative T-ALL immunophenotypes as characterized by mpFC of ETP sub-type (top row), near-ETP subtype (middle row) and typical ALL/non-ETP subtype (bottom row). T lymphoblast populations are shown in teal. Reported criteria for ETP immunophenotype were used (5). Five of 43 cases had an ETP immunophenotype. Eight of 43 cases had a near-ETP immunophenotype. The other 30 cases were typical T-ALL and were neither ETP nor near-ETP.

Samples PT_13, 39, 42, 45, 56, 60 and 68 were classified as ETP.
Samples PT_3, 12, 54, 55 and 57 were classified as nETP (FIGS. 2 and 3).

TABLE 6

% of T cells that were Blasts at Day 0 and Day 29 Characterization by mpFC and HTS of TCRB/TCRG

| | Day 0 | | | Day 29 | | |
| | mpFC | HTS | | mpFC | HTS | |
| Sample | Blast/T cells | TCRB | TCRG | Blast/T cells | TCRB | TCRG |
|---|---|---|---|---|---|---|
| 1 | 0.931289641 | 0.869862606 | 52.5254048 | 0 | 4.4024E-05 | 0.03937815 |
| 2 | 0.814775161 | 0.747941989 | 82.3288372 | 0.08156607 | 0.02893032 | 4.63888072 |
| 3 | 0.986947791 | 0.017557079 | 12.3924143 | 0.00202703 | 0 | |
| 4 | 0.992957746 | 0.961903091 | 54.7257337 | 0.04795737 | 0.1614654 | 7.45339935 |
| 5 | 0.886813187 | 0.809100213 | 41.6389335 | 0 | 1.4101E-05 | 0.01490627 |
| 6 | 0.981891348 | 0.95963063 | 58.557176 | 0 | 0.01420907 | 1.25544372 |
| 7 | 0.972699697 | 0.984716924 | 0.59258927 | 0 | 0 | 0 |
| 8 | 0.979859013 | 0.638302477 | 70.6051915 | 0 | 0.0004481 | 0 |
| 9 | 0.970377937 | 0.98506196 | 50 | 0 | 0 | 0 |
| 11 | 0.96177686 | 0.006945971 | 94.6793227 | 0 | 0 | 19.9611535 |
| 12 | 0.892638037 | 0.014932055 | 4.16576441 | 0.05456989 | 0 | |
| 13 | 0.959474261 | 0.050950488 | 0.05179646 | 0.76954315 | 0 | |

TABLE 6-continued

% of T cells that were Blasts at Day 0 and Day 29
Characterization by mpFC and HTS of TCRB/TCRG

| | Day 0 | | | Day 29 | | |
|---|---|---|---|---|---|---|
| | mpFC | HTS | | mpFC | HTS | |
| Sample | Blast/T cells | TCRB | TCRG | Blast/T cells | TCRB | TCRG |
| 14 | 0.918981481 | 0.88730182 | 84.245218 | 0.14479026 | 0.0154863 | 7.92210056 |
| 15 | 0.972477064 | 0.966418465 | 80.8011935 | 0 | 0 | 0.04827268 |
| 30 | 0.67403315 | 0.489840689 | 17.1898345 | | 0.00048091 | |
| 32 | 0.87001287 | 0.863124126 | 64.0647828 | | 0.00013614 | 0.08466056 |
| 33 | 0.36514523 | 0.389789133 | 6.58138203 | | 0 | |
| 36 | 0.63565891 | 0.776347236 | 55.128848 | | 0 | |
| 39 | 1 | 0.98803323 | 78.3268267 | | 0.00201475 | 7.67E−04 |
| 40 | 0.5815508 | 0.515729332 | 35.0639536 | 0.0990566 | 0.09248403 | |
| 41 | 0.90253807 | 0.928676259 | 59.2559701 | 0.00152838 | 0.00292659 | 0.1406089 |
| 42 | 0.91920252 | 0.08504223 | ND | 0.0019544 | 0.01346556 | |
| 44 | 0.97672065 | 0.994348041 | 96.9885863 | 0 | 0 | |
| 45 | 0.99296482 | 0.077544426 | 10.8482546 | 0.2345679 | 0 | |
| 47 | 0.83670295 | 0.58431047 | 27.5213337 | 0.02276786 | 0.03573035 | |
| 48 | 0.98097252 | 0.988028346 | 12.2479173 | 0 | 0 | |
| 49 | 0.94558522 | 0.933572687 | 72.0934554 | 0 | 0.00070619 | |
| 50 | 0.98088531 | 0.994709258 | | | 3.4997E−05 | |
| 51 | 0.95571576 | 0.948955408 | 61.973728 | 0.00797546 | 0.0047952 | |
| 52 | 0.87757202 | 0.97285037 | 13.5297526 | | 5.0976E−06 | |
| 53 | 0.96843177 | 0.986362564 | 8.64156011 | | 4.6305E−06 | |
| 54 | 0.97082495 | 0.107187084 | 71.5454996 | 0.069869 | 0.08321639 | |
| 55 | 0.98183653 | 0.120066146 | 4.8143757 | 0.43255814 | 0 | |
| 56 | 0.86721144 | 0.017651493 | 33.7748913 | 0.1245283 | 0.00564494 | |
| 57 | 0.95523906 | 0.020885717 | 71.2907132 | 0.6459144 | 0.00838002 | 0.16145989 |
| 58 | 0.68115942 | 0.586476251 | 14.9081924 | 0.05369128 | 0.03701839 | 3.40390897 |
| 59 | 0.92966361 | 0.936086965 | ND | 0 | 0 | |
| 60 | 0.90118153 | 0.037093219 | ND | 0.05792683 | 0 | |
| 61 | 0.93349456 | 0.625504008 | 56.3484994 | 0.00653266 | 0.02535341 | 0.03928545 |
| 63 | 0.971875 | 0.994335907 | 76.362186 | | 0 | |
| 65 | 0.9563795 | 0.840250471 | 92.723888 | 0.00114679 | 7.6499E−05 | 0.03433687 |
| 66 | 0.71351351 | 0.869202008 | 11.7433739 | | 0.00276186 | |
| 68 | 0.9874477 | 0.024076739 | ND | 0.00849858 | 0.0424174 | |

ND; not determined.

In general, each of these clonal sequences represented at least 15% of the total T-cell repertoire of the subject at diagnosis, a proportion that was greater than three standard deviations from the mean of reactive T-cell clones in normal individuals (Table 7 and FIG. 5). At day 0, a clonal population of TCRB was readily identified in 31 of 43 cases (FIG. 1A; FIG. 4). By contrast, 12 patient samples did not have an identifiable clonal TCRB sequence at diagnosis, defined as that comprising less than 15% of total sequences. Of the 12 patients in whom no clonal TCRB sequence was identified, four had a clonal TCRG rearrangement on concurrent analysis (Table 6).

TABLE 7

Frequency of Occurrence of Highest-Frequency
Clones in Normal Control Subjects

| Healthy Control | Most Frequent Clone |
|---|---|
| AS | 2.1975 |
| BC | 0.6709 |
| CD | 1.6264 |
| HR | 7.7823 |
| JA | 1.6008 |
| RL | 8.7205 |
| Average | 3.7664 |
| SD | 3.520896205 |
| Average + 3SD | 14.32908862 |

With knowledge of the specific CDR sequences of the patient's clonal population from day 0, the ability of HTS to identify the clonal sequence at day 29 was next examined, and these findings were compared to results of mpFC that were performed as part of the current protocol at the University of Washington in the Children's Oncology Group AALL0434 trial. In light of the patient's original clonal TCRB and TCRG sequences at diagnosis, high-throughput sequencing of these patient samples at day 29 revealed three sub-groups of patients in this cohort: 1) those for whom MRD was not detected by HTS or mpFC, 9 cases; 2) those for whom MRD was detected by both HTS and mpFC, 12 cases; and 3) a subset for whom MRD was detectable by HTS, but not by mpFC, 10 cases (FIG. 1B). In general, there was approximately a 100-fold increase in the sensitivity with which MRD could be detected by the herein disclosed HTS methodology, as compared to mpFC.

Of the cases for which no clonal TCRB population was identified at day 0, further evaluation showed that these patients generally had high levels of MRD at day 29. Review of the immunophenoptype of the patients' T lymphoblasts at day 0 showed that of the 12 cases, 5 had an immunophenotype compatible with an early thymic-precursor (ETP) sub-type, whereas 7 had a near-ETP immunophenotype, in which some but not all of the immunophenotypic criteria for ETP were met (Table 5) (15). The association of higher minimal residual disease in patients with lymphoblasts of ETP immunophenotype ($x=0.1848$) versus non-ETP T-ALL (mean=0.01613, Fisher's statistic) was compatible with previous reports identifying this sub-group as having a more aggressive clinical course with increased propensity for disease relapse. Based on these data, the near-ETP group appeared in its characteristics to occupy a position along a continuum between non-ETP and ETP-subtypes of T-ALL.

To evaluate the specificity of HTS for assessment of MRD, evaluation was conducted of the frequency of occurrence of a specific TCR clonal sequence from one patient being present in the other 41 patient samples at day 29. This analysis demonstrated 15 "false positives" of 1,722 TCRG gene comparisons (=$N^2-N=42^2 42=1,722$) for TCRG and 3 "false positives" of 1,722 comparisons for TCRB. Of note, the level of these false positive clones was much lower, by one order of magnitude, as compared to true MRD positives.

Discussion

Recent data from the AIEOP-BFM-ALL 2000 study, a multi-institutional, prospective clinical trial involving 464 patients with T-ALL confirmed the importance of minimal residual disease (MRD) to categorize standard, intermediate and high-risk disease on the basis of MRD at two time points post-therapy (2). Patients with detectable MRD of greater than $10^{-3}$ cells at the second time-point, TP2 (day 78) fared poorly, such that persistent MRD at TP2 was concluded to be an important predictive factor for T-ALL relapse. Detection of this level of disease was readily within the sensitivity of the present HTS technology as shown herein, whereby determination of clonality was achieved without the laborious requirements for individualized PCR or allele-specific oligonucleotide design of prior approaches to MRD. HTS was readily scalable, less organizationally complex than prior methodologies, and readily adaptable to any clinical laboratory environment.

In the present Example, TCRG sequencing was suitable for detecting clonality in a slightly greater proportion of cases as compared to TCRB, but TCRB was also regarded as highly useful for MRD assessment due to the relatively greater germ-line diversity of TCRB relative to TCRG. In analyses of day 29 samples, clonal TCR sequences were found to be highly specific with coincidental identification of cross-patient sequences—that is, identification of the clonal sequence of one patient in the other 41 patients sequenced in this study, being generally rare. Previously described molecular protocols for MRD detection using custom-prepared, patient-specific primers (7, 8) disadvantageously did not routinely test for cross-patient specificity, as evaluation of sensitivity (e.g., % of subjects correctly identified as MRD+ by given criteria) and not specificity (e.g., % of subjects correctly identified as MRD− by given criteria) was the only requirement for the prior assays. As such, the present HTS methods also permitted identification of rare, coincidental overlap of TCR gene sequences from one patient to another. Notably, the level of these shared sequences detectable in such false-positive, cross-patient comparisons was much lower than seen in true patient MRD cases. Importantly, for T-ALL MRD, TCR gene rearrangements appeared to be stable, with limited evidence (less than 5%) for clonal evolution.

The presently described HTS methodology contributed to disease-prognostication at diagnosis for T-ALL for a subset of cases, by identifying samples in which there was no TCRB gene rearrangement at diagnosis, despite evidence for a high proportion of T lymphoblasts by mpFC. These cases tended to have either an early thymic precursor-like immunophenotype, or similar immunophenotypic characteristics that were described herein as being near-ETP like (15). An ETP subtype of T-ALL has been proposed to be derived from an immunogenetically early subset of T-cells prior to TCR gene rearrangement, although a recent study suggests such a subset may also have represented reversion from the double-positive immature T-cell state to a more immature immunophenotype (16). Comparison with flow cytometry results of MRD at day 29 showed that the 12 cases, for which no clonal TCRB sequence was identified at pre-treatment, had increased MRD at day 29, consistent with a more aggressive clinical course of these ETP-like tumors.

The utility of HTS for sequencing of lymphoid adaptive immune receptor encoding genes in T-ALL is extendable to routine clinical monitoring by HTS of lymphoid adaptive immune receptor encoding genes in acute B-cell lymphoblastic leukemia/lymphomas (B-ALL). MRD determination in B-ALL, by molecular and mpFC techniques, has been shown to be important for patient prognosis (3). B-ALL commonly shows cross-lineage (B to T) rearrangements of TCRB and/or TCRG, so the approach described herein is directly applicable to a subset of B-ALL cases (1). Similarly, HTS of immunoglobulin heavy chain gene rearrangements can also readily be performed based on the teachings provided herein.

REFERENCES

1. Flohr et al., *Leukemia* 22, 771-782 (2008).
2. Schrappe et al., *Blood* 118, 2077-2084).
3. van Dongen et al., *Lancet* 352, 1731-1738 (1998).
4. D. Campana, *Hematology Am Soc Hematol Educ Program* 2010, 7-12).
5. Campana, *Curr Hematol Malig Rep* 5, 169-176 (2010).
6. Roshal et al., *Cytometry B Clin Cytom* 78, 139-146).
7. van der Velden et al., *Leukemia* 21, 706-713 (2007).
8. van der Velden et al., *Leukemia* 21, 604-611 (2007).
9. Robins et al., *Blood* 114, 4099-4107 (2009).
10. Robins et al., *Sci Transl Med* 2, 47ra64 (2010).
11. Sherwood et al., *Sci Transl Med* 3, 90ra61 (2011).
12. Kalos et al., *Sci Transl Med* 3, 95ra73 (2011).
13. Boyd et al., *Sci Transl Med* 1, 12ra23 (2009).
14. Robins, Desmarais, Mat this, Livingston, Andriesen, Reijonen, Carlson, Nepom, Yee, Cerosaletti, Ultra-sensitive detection of rare T cell clones. *J Immunol Methods* doi:10.1016/j.jim.2011.09.001 (Sep. 10, 2011 Epub ahead of print PMID 21945395).
15. Coustan-Smith et al., *Lancet Oncol* 10, 147-156 (2009).
16. Berquam-Vrieze et al., *Blood* 118, 4646-4656).
17. Wood et al., *Arch Pathol Lab Med* 130, 680-690 (2006).
18. Yousfi Monod et al., *Bioinformatics* 20 Suppl 1, i379-385 (2004).

Example 2

Use of the Template Composition to Determine Amplification Factor

This example describes quantification of rearranged DNA molecules encoding a plurality of IG molecules, using the presently described template oligonucleotide composition as a "spiked-in" synthetic template in a multiplexed PCR amplification of a DNA sample containing B cell and fibroblast DNA.

Biological Template DNA: Eight biological samples were used as sources of template DNA, with each biological sample containing the same amount of total genomic DNA (gDNA), 300 ng, but in a different proportion of (i) DNA extracted from B cells to (ii) DNA extracted from human fibroblast cells, a cell type in which IG and TCR encoding genes do not rearrange. The samples contained either 0, 0.07, 0.3, 1, 4, 18, 75 or 300 ng B cell gDNA, with fibroblast gDNA supplying the balance of each 300 ng gDNA preparation. Four replicates of each sample were made.

Synthetic Template DNA: To each PCR reaction (below) were added 5000 molecules (4-5 molecules of each sequence) from an oligonucleotide template composition comprising a pool of 1116 synthetic IGH template oligonucleotide molecules (SEQ ID NOS:4085-5200). (An IGH template composition comprising a set of 1116 template oligonucleotides is also disclosed in the Sequence Listing as SEQ ID NOS:1805-2920.

PCR Reaction: The PCR reaction used QIAGEN Multiplex Plus™ PCR master mix (QIAGEN part number 206152, Qiagen, Valencia, Calif.), 10% Q-solution (QIAGEN), and 300 ng of biological template DNA (described above). The pooled amplification primers were added so the final reaction had an aggregate forward primer concentration of 2 µM and an aggregate reverse primer concentration of 2 µM. The forward primers (SEQ ID NOS:5201-5286) included 86 primers that had at the 3' end an approximately 20 bp segment that annealed to the IGH V segment encoding sequence and at the 5' end an approximately 20 bp universal primer pGEXf. The reverse primers (SEQ ID NOS:5287-5293) included an aggregate of J segment specific primers that at the 3' end had an approximately 20 bp segment that annealed to the IGH J segment encoding sequence and at the 5' end of the J primers was a universal primer pGEXr. The following thermal cycling conditions were used in a C100 thermal cycler (Bio-Rad Laboratories, Hercules, Calif., USA): one cycle at 95° C. for 10 minutes, 30 cycles at 94° C. for 30 seconds, 63° C. for 30 seconds, and 72° C. for one minute, followed by one cycle at 72° C. for 10 minutes. Each reaction was run in quadruplicates.

For sequencing, Illumina adapters (Illumina Inc., San Diego, Calif.), which also included a 8 bp tag and a 6 bp random set of nucleotides, were incorporated onto the ends of the PCR reaction products in a 7 cycle PCR reaction. The PCR reagents and conditions were as described above, except for the thermocycle conditions, which were: 95° C. for 5 minutes, followed by 7 cycles of 95° for 30 sec, 68° for 90 sec, and 72° for 30 sec. Following thermal cycling, the reactions were held for 10 minutes at 72° and the primers were the Illumina adaptor tailing primers (SEQ ID NOS: 5387-5578). Samples were sequenced on an Illumina MiSEQ™ sequencer using the Illumina_PE_RD2 primer.

Results. Sequence data were obtained for each sample and amplification products of synthetic templates were identified by the presence of the barcode oligonucleotide sequence. For each sample, the number of template products was divided by the number of unique synthetic template oligonucleotide sequences (1116) to arrive at a sample amplification factor. The total number of amplification products of the biological templates for each sample was then divided by the amplification factor to calculate the number of rearranged biological template molecules (e.g., VDJ recombinations) in the starting amplification reaction as an estimate of the number of unique B cell genome templates. The average values with standard deviations were plotted against the known number of rearranged biological template molecules based on B cell input (FIG. 8). In FIG. 8, the dots represent the average amplification factor and the bars represent the standard deviation across the four replicates. The use of amplification factors calculated as described herein to estimate the number of VJ-rearranged IG encoding molecules (as a proxy value for the number of B cells) yielded determinations that were consistent with known B cell numbers at least down to an input of 100 B cells. The estimated amplification factor values and the observed amplification factor were highly correlated (FIG. 8, $R^2=0.9988$).

The various embodiments described above can be combined to provide further embodiments. All of the U.S. patents, U.S. patent application publications, U.S. patent applications, foreign patents, foreign patent applications and non-patent publications referred to in this specification and/or listed in the Application Data Sheet are incorporated herein by reference, in their entirety. Aspects of the embodiments can be modified, if necessary to employ concepts of the various patents, applications and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (6388 sequences)

SEQ ID NO: 1 - DNA, 495 bp, Artificial Sequence
  Oligonucleotide
gcctccctcgcgccatcagagagtgtcacgtgtgtctgtggacccacttttccctgtgacggatctgcaaaagaacctgaaaaatgtcttacctacaactgtgagtctggtgccttgtccaaagaaagcttcagtgtcgacagagtgtcacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagaagagtgtcacgtgtgtctgagcgggctggcaaggc

SEQ ID NO: 2 - DNA, 495 bp, Artificial Sequence
  Oligonucleotide
gcctccctcgcgccatcaggttccgaaacgtgtgtatttcccaggacagagtcctccctcatcgcacccctcctagagacccccagccttacctacaacggttaacctggtccccgaaccgaaggtgtagccatagtcgacgttccgaaacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagagttccgaaacgtgtgtctgagcgggctggcaaggc

SEQ ID NO: 3 - DNA, 495 bp, Artificial Sequence
  Oligonucleotide
gcctccctcgcgccatcagcgttacttacgtgtgtctggattccagcccctttttgcaagttcccagctgtccagccttgacttactcacctacaacagtgagccaacttccctctccaaaatatatggtgtttcgtcgaccgttacttacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagacgttacttacgtgtgtctgagcgggctggcaaggc

SEQ ID NO: 4 - DNA, 495 bp, Artificial Sequence
  Oligonucleotide
gcctccctcgcgccatcagtaggagacacgtgtgtctcctggaactccgaccttatgatacactatcccgaaagaagtcttttacatacccaagacagagagctgggttccactgccaaaaaacagtttttcattgtcgactaggagacacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagataggagacacgtgtgtctgagcgggctggcaaggc

SEQ ID NO: 5 - DNA, 495 bp, Artificial Sequence
  Oligonucleotide
gcctccctcgcgccatcaggacactctacgtgtgtagagaactctgccttcaagggacaatggccataccaccctgattctgcaacttacctaggatggagagtcgagtcccatcaccaaaatgctggggctgatgtcgacgacactctacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagagacactctacgtgtgtctgagcgggctggcaaggc

SEQ ID NO: 6 - DNA, 495 bp, Artificial Sequence
  Oligonucleotide
gcctccctcgcgccatcagttcggaacacgtgtgtatcattgcagtcaaacccaggcacccccgagtcaagagtggagcccccatacctgtcacagtgagcctggtcccgttcccaaagtggaggggtgaattatgtcgacttcggaacacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagattcggaacacgtgtgtctgagcgggctggcaaggc

SEQ ID NO: 7 - DNA, 495 bp, Artificial Sequence
  Oligonucleotide
gcctccctcgcgccatcagaagtaacgacgtgtgtgggtcgtgcaggctgggctgctcaccctctctcccacctggagcccccttcttacctagcacggtgagccgtgtccctggcccgaagaactgctcattgtgtcgacaagtaacgacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagaaagtaacgacgtgtgtctgagcgggctggcaaggc

SEQ ID NO: 8 - DNA, 495 bp, Artificial Sequence
  Oligonucleotide
gcctccctcgcgccatcaggtctcctaacgtgtgtcctctgcccatcccgccctctcggagctctccggagccccaaccgcctccttacccagtacggtcagcctagagccttctccaaaaaacagctccccggtgtcgacgtctcctaacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagagtctcctaacgtgtgtctgagcgggctggcaaggc

SEQ ID NO: 9 - DNA, 495 bp, Artificial Sequence
  Oligonucleotide
gcctccctcgcgccatcaggtagacacacgtgtgtgcgtcccggggcgccccctccccagttccggggcttcagcgggagcccccgcttaccgagcactgtcagccgggtgcctgggccaaaatactgcgtatctgtcgacgtagacacacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagagtagacacacgtgtgtctgagcgggctggcaaggc

SEQ ID NO: 10 - DNA, 495 bp, Artificial Sequence
  Oligonucleotide
gcctccctcgcgccatcagcactgtacacgtgtgtcgcacaaaaacccgagcgcagtctcgtccccggtcccccggcggccccagcttacccagcactgagagccgggtcccggcgccgaagtactgaatgttttgtcgaccactgtacacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagacactgtacacgtgtgtctgagcgggctggcaaggc

SEQ ID NO: 11 - DNA, 495 bp, Artificial Sequence
  Oligonucleotide
gcctccctcgcgccatcaggatgatccacgtgtgtccccgcaaaaaccagacccaagccgcccgcgcccgcgccccagcagcccgcgctcaccgagcaccaggagccgcgtgcctggcccgaagtactgggtctcgtcgacgatgatccacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagagatgatccacgtgtgtctgagcgggctggcaaggc

SEQ ID NO: 12 - DNA, 495 bp, Artificial Sequence
  Oligonucleotide
gcctccctcgcgccatcagcgccaataacgtgtgtccgccgccttccacctgaatcccgccgcccgggtggtcccgcgaaaactcacccagcacggtcagcctgctgccggccccgaaagtcaggacgttggcccgtcgaccgccaataacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagacgccaataacgtgtgtctgagcgggctggcaaggc

SEQ ID NO: 13 - DNA, 495 bp, Artificial Sequence
  Oligonucleotide
gcctccctcgcgccatcagtcaagcctacgtgtgtccaccctccgactccggggaccgaggggctggaaggtggggagacgcccgaatctcacctgtgaccgtgagcctggtgcccggcccgaagtactgctcgtgtcgactcaagcctacgtgtgttcactgctggtgcagagatacgcagctgagtcttcttgctgcagtgcgaccacatgaaggtataagcgagagctgtcagggcattcaggtgtgaagtgatttggcacagtcttgttttcaatgaattccttacagttgtagtaaaacatgaactccagggatttcttagctttctgtctgtaccaatacatagaatcatgtcccagatgctcacgtttcattgtccttttactccccattgctgtgaccaggtattttggtgtctgggtaattccagtatccatggagcctatgaaaataagatcaagcctacgtgtgtctgagcgggctggcaaggc

SEQ ID NO: 14 - DNA, 495 bp, Artificial Sequence
  Oligonucleotide
gcctccctcgcgccatcagagagtgtctccgtctactgtggacccacttttccctgtgacggatctgcaaaagaacctgaaaaatgtcttacctacaactgtgagtctggtgccttgtccaaagaaagcttcagtgtcgacagagtgtctccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagaagagtgtctccgtctactgagcgggctggcaaggc

SEQ ID NO: 15 - DNA, 495 bp, Artificial Sequence
  Oligonucleotide
gcctccctcgcgccatcaggttccgaatccgtctaatttcccaggacagagtcctccctcatcgcacccctcctagagacccccagccttacctacaacggttaacctggtccccgaaccgaaggtgtagccatagtcgacgttccgaatccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagagttccgaatccgtctactgagcgggctggcaaggc

SEQ ID NO: 16 - DNA, 495 bp, Artificial Sequence
  Oligonucleotide
gcctccctcgcgccatcagcgttactttccgtctactggattccagcccctttttgcaagttcccagctgtccagccttgacttactcacctacaacagtgagccaacttccctctccaaaatatatggtgtttcgtcgaccgttactttccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagacgttactttccgtctactgagcgggctggcaaggc

SEQ ID NO: 17 - DNA, 495 bp, Artificial Sequence
  Oligonucleotide
gcctccctcgcgccatcagtaggagactccgtctactcctggaactccgaccttatgatacactatcccgaaagaagtcttttacatacccaagacagagagctgggttccactgccaaaaaacagtttttcattgtcgactaggagactccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagataggagactccgtctactgagcgggctggcaaggc

SEQ ID NO: 18 - DNA, 495 bp, Artificial Sequence
  Oligonucleotide
gcctccctcgcgccatcaggacactcttccgtctaagagaactctgccttcaagggacaatggccataccaccctgattctgcaacttacctaggatggagagtcgagtcccatcaccaaaatgctggggctgatgtcgacgacactcttccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagagacactcttccgtctactgagcgggctggcaaggc

SEQ ID NO: 19 - DNA, 495 bp, Artificial Sequence
  Oligonucleotide
gcctccctcgcgccatcagttcggaactccgtctaatcattgcagtcaaacccaggcacccccgagtcaagagtggagcccccatacctgtcacagtgagcctggtcccgttcccaaagtggaggggtgaattatgtcgacttcggaactccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagattcggaactccgtctactgagcgggctggcaaggc

SEQ ID NO: 20 - DNA, 495 bp, Artificial Sequence
  Oligonucleotide
gcctccctcgcgccatcagaagtaacgtccgtctagggtcgtgcaggctgggctgctcaccctctctcccacctggagcccccttcttacctagcacggtgagccgtgtccctggcccgaagaactgctcattgtgtcgacaagtaacgtccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagaaagtaacgtccgtctactgagcgggctggcaaggc

SEQ ID NO: 21 - DNA, 495 bp, Artificial Sequence
  Oligonucleotide
gcctccctcgcgccatcaggtctcctatccgtctacctctgcccatcccgccctctcggagctctccggagccccaaccgcctccttacccagtacggtcagcctagagccttctccaaaaaacagctccccggtgtcgacgtctcctatccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagagtctcctatccgtctactgagcgggctggcaaggc

SEQ ID NO: 22 - DNA, 495 bp, Artificial Sequence
  Oligonucleotide
gcctccctcgcgccatcaggtagacactccgtctagcgtcccggggcgccccctccccagttccggggcttcagcgggagcccccgcttaccgagcactgtcagccgggtgcctgggccaaaatactgcgtatctgtcgacgtagacactccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagagtagacactccgtctactgagcgggctggcaaggc

SEQ ID NO: 23 - DNA, 495 bp, Artificial Sequence
  Oligonucleotide
gcctccctcgcgccatcagcactgtactccgtctacgcacaaaaacccgagcgcagtctcgtccccggtcccccggcggccccagcttacccagcactgagagccgggtcccggcgccgaagtactgaatgttttgtcgaccactgtactccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagacactgtactccgtctactgagcgggctggcaaggc

SEQ ID NO: 24 - DNA, 495 bp, Artificial Sequence
  Oligonucleotide
gcctccctcgcgccatcaggatgatcctccgtctaccccgcaaaaaccagacccaagccgcccgcgcccgcgccccagcagcccgcgctcaccgagcaccaggagccgcgtgcctggcccgaagtactgggtctcgtcgacgatgatcctccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagagatgatcctccgtctactgagcgggctggcaaggc

SEQ ID NO: 25 - DNA, 495 bp, Artificial Sequence
  Oligonucleotide
gcctccctcgcgccatcagcgccaatatccgtctaccgccgccttccacctgaatcccgccgcccgggtggtcccgcgaaaactcacccagcacggtcagcctgctgccggccccgaaagtcaggacgttggcccgtcgaccgccaatatccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagacgccaatatccgtctactgagcgggctggcaaggc

SEQ ID NO: 26 - DNA, 495 bp, Artificial Sequence
  Oligonucleotide
gcctccctcgcgccatcagtcaagccttccgtctaccaccctccgactccggggaccgaggggctggaaggtggggagacgcccgaatctcacctgtgaccgtgagcctggtgcccggcccgaagtactgctcgtgtcgactcaagccttccgtctatcactgctggcacagaagtacatggctgagtcctccagctttgtggaccggatcttcagagtgaaatttgatccatcaggcctttcaactgagaattgatcatcgaatatttcagacttctctgagatttcattattataaaaggaaaccagaaactcgactttctgccccaagatttgtctgtaccaatagaagtataagtgattagagatggggacacagcgcaagatcacttcctgtcccatctgtgtgacctgatggctgggagtctgggtgacttcaggttctgtgagtcctgtgagatcaagccttccgtctactgagcgggctggcaaggc

SEQ ID NO: 27 - DNA, 495 bp, Artificial Sequence
  Oligonucleotide
gcctccctcgcgccatcagagagtgtcaagagctgctgtggacccacttttccctgtgacggatctgcaaaagaacctgaaaaatgtcttacctacaactgtgagtctggtgccttgtccaaagaaagcttcagtgtcgacagagtgtcaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaaagagtgtcaagagctgctgagcgggctggcaaggc

SEQ ID NO: 28 - DNA, 495 bp, Artificial Sequence
  Oligonucleotide
gcctccctcgcgccatcaggttccgaaaagagctgatttcccaggacagagtcctccctcatcgcacccctcctagagacccccagccttacctacaacggttaacctggtccccgaaccgaaggtgtagccatagtcgacgttccgaaaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaagttccgaaaagagctgctgagcgggctggcaaggc

SEQ ID NO: 29 - DNA, 495 bp, Artificial Sequence
  Oligonucleotide
gcctccctcgcgccatcagcgttacttaagagctgctggattccagcccctttttgcaagttcccagctgtccagccttgacttactcacctacaacagtgagccaacttccctctccaaaatatatggtgtttcgtcgaccgttacttaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaacgttacttaagagctgctgagcgggctggcaaggc

SEQ ID NO: 30 - DNA, 495 bp, Artificial Sequence
  Oligonucleotide
gcctccctcgcgccatcagtaggagacaagagctgctcctggaactccgaccttatgatacactatcccgaaagaagtcttttacatacccaagacagagagctgggttccactgccaaaaaacagtttttcattgtcgactaggagacaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaataggagacaagagctgctgagcgggctggcaaggc

SEQ ID NO: 31 - DNA, 495 bp, Artificial Sequence
  Oligonucleotide
gcctccctcgcgccatcaggacactctaagagctgagagaactctgccttcaagggacaatggccataccaccctgattctgcaacttacctaggatggagagtcgagtcccatcaccaaaatgctggggctgatgtcgacgacactctaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaagacactctaagagctgctgagcgggctggcaaggc

SEQ ID NO: 32 - DNA, 495 bp, Artificial Sequence
  Oligonucleotide
gcctccctcgcgccatcagttcggaacaagagctgatcattgcagtcaaacccaggcacccccgagtcaagagtggagcccccatacctgtcacagtgagcctggtcccgttcccaaagtggaggggtgaattatgtcgacttcggaacaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaattcggaacaagagctgctgagcgggctggcaaggc

SEQ ID NO: 33 - DNA, 495 bp, Artificial Sequence
  Oligonucleotide
gcctccctcgcgccatcagaagtaacgaagagctggggtcgtgcaggctgggctgctcaccctctctcccacctggagcccccttcttacctagcacggtgagccgtgtccctggcccgaagaactgctcattgtgtcgacaagtaacgaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaaaagtaacgaagagctgctgagcgggctggcaaggc

SEQ ID NO: 34 - DNA, 495 bp, Artificial Sequence
  Oligonucleotide
gcctccctcgcgccatcaggtctcctaaagagctgcctctgcccatcccgccctctcggagctctccggagccccaaccgcctccttacccagtacggtcagcctagagccttctccaaaaaacagctccccggtgtcgacgtctcctaaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaagtctcctaaagagctgctgagcgggctggcaaggc

SEQ ID NO: 35 - DNA, 495 bp, Artificial Sequence
  Oligonucleotide
gcctccctcgcgccatcaggtagacacaagagctggcgtcccggggcgccccctccccagttccggggcttcagcgggagcccccgcttaccgagcactgtcagccgggtgcctgggccaaaatactgcgtatctgtcgacgtagacacaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaagtagacacaagagctgctgagcgggctggcaaggc

SEQ ID NO: 36 - DNA, 495 bp, Artificial Sequence
  Oligonucleotide
gcctccctcgcgccatcagcactgtacaagagctgcgcacaaaaacccgagcgcagtctcgtccccggtcccccggcggccccagcttacccagcactgagagccgggtcccggcgccgaagtactgaatgttttgtcgaccactgtacaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaacactgtacaagagctgctgagcgggctggcaaggc

SEQ ID NO: 37 - DNA, 495 bp, Artificial Sequence
  Oligonucleotide
gcctccctcgcgccatcaggatgatccaagagctgccccgcaaaaaccagacccaagccgcccgcgcccgcgccccagcagcccgcgctcaccgagcaccaggagccgcgtgcctggcccgaagtactgggtctcgtcgacgatgatccaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaagatgatccaagagctgctgagcgggctggcaaggc

SEQ ID NO: 38 - DNA, 495 bp, Artificial Sequence
  Oligonucleotide
gcctccctcgcgccatcagcgccaataaagagctgccgccgccttccacctgaatcccgccgcccgggtggtcccgcgaaaactcacccagcacggtcagcctgctgccggccccgaaagtcaggacgttggcccgtcgaccgccaataaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaacgccaataaagagctgctgagcgggctggcaaggc

SEQ ID NO: 39 - DNA, 495 bp, Artificial Sequence
  Oligonucleotide
gcctccctcgcgccatcagtcaagcctaagagctgccaccctccgactccggggaccgaggggctggaaggtggggagacgcccgaatctcacctgtgaccgtgagcctggtgcccggcccgaagtactgctcgtgtcgactcaagcctaagagctgtcactgctggcacagaaatacacagcagagtcaccaagctccagggaattgatgtgaagatttaagtgagctttgtctggagatttaggtgagaagcgatttggaactgtttcatttataatgagctccttattattgtagctaaacattatcttcagaaatttcttagagtcctgtttataccaatacatagtatcatggcccagattttgttcacatttaatggacttgtcgtttcccatctgtgtgaccaggtattttggagtctgggaaacagctgtgtccaagggacctgcaaaggaatcaagcctaagagctgctgagcgggctggcaaggc

SEQ ID NO: 40 - DNA, 495 bp, Artificial Sequence
  Oligonucleotide
gcctccctcgcgccatcagagagtgtctatcgctcctgtggacccacttttccctgtgacggatctgcaaaagaacctgaaaaatgtcttacctacaactgtgagtctggtgccttgtccaaagaaagcttcagtgtcgacagagtgtctatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaaagagtgtctatcgctcctgagcgggctggcaaggc

SEQ ID NO: 41 - DNA, 495 bp, Artificial Sequence
  Oligonucleotide
gcctccctcgcgccatcaggttccgaatatcgctcatttcccaggacagagtcctccctcatcgcacccctcctagagacccccagccttacctacaacggttaacctggtccccgaaccgaaggtgtagccatagtcgacgttccgaatatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaagttccgaatatcgctcctgagcgggctggcaaggc

SEQ ID NO: 42 - DNA, 495 bp, Artificial Sequence
  Oligonucleotide
gcctccctcgcgccatcagcgttactttatcgctcctggattccagcccctttttgcaagttcccagctgtccagccttgacttactcacctacaacagtgagccaacttccctctccaaaatatatggtgtttcgtcgaccgttactttatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaacgttactttatcgctcctgagcgggctggcaaggc

SEQ ID NO: 43 - DNA, 495 bp, Artificial Sequence
  Oligonucleotide
gcctccctcgcgccatcagtaggagactatcgctcctcctggaactccgaccttatgatacactatcccgaaagaagtcttttacatacccaagacagagagctgggttccactgccaaaaaacagtttttcattgtcgactaggagactatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaataggagactatcgctcctgagcgggctggcaaggc

SEQ ID NO: 44 - DNA, 495 bp, Artificial Sequence
  Oligonucleotide
gcctccctcgcgccatcaggacactcttatcgctcagagaactctgccttcaagggacaatggccataccaccctgattctgcaacttacctaggatggagagtcgagtcccatcaccaaaatgctggggctgatgtcgacgacactcttatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaagacactcttatcgctcctgagcgggctggcaaggc

SEQ ID NO: 45 - DNA, 495 bp, Artificial Sequence
  Oligonucleotide
gcctccctcgcgccatcagttcggaactatcgctcatcattgcagtcaaacccaggcacccccgagtcaagagtggagcccccatacctgtcacagtgagcctggtcccgttcccaaagtggaggggtgaattatgtcgacttcggaactatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaattcggaactatcgctcctgagcgggctggcaaggc

SEQ ID NO: 46 - DNA, 495 bp, Artificial Sequence
  Oligonucleotide
gcctccctcgcgccatcagaagtaacgtatcgctcgggtcgtgcaggctgggctgctcaccctctctcccacctggagcccccttcttacctagcacggtgagccgtgtccctggcccgaagaactgctcattgtgtcgacaagtaacgtatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaaaagtaacgtatcgctcctgagcgggctggcaaggc

SEQ ID NO: 47 - DNA, 495 bp, Artificial Sequence
  Oligonucleotide
gcctccctcgcgccatcaggtctcctatatcgctccctctgcccatcccgccctctcggagctctccggagccccaaccgcctccttacccagtacggtcagcctagagccttctccaaaaaacagctccccggtgtcgacgtctcctatatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaagtctcctatatcgctcctgagcgggctggcaaggc

SEQ ID NO: 48 - DNA, 495 bp, Artificial Sequence
  Oligonucleotide
gcctccctcgcgccatcaggtagacactatcgctcgcgtcccggggcgccccctccccagttccggggcttcagcgggagcccccgcttaccgagcactgtcagccgggtgcctgggccaaaatactgcgtatctgtcgacgtagacactatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaagtagacactatcgctcctgagcgggctggcaaggc

SEQ ID NO: 49 - DNA, 495 bp, Artificial Sequence
  Oligonucleotide
gcctccctcgcgccatcagcactgtactatcgctccgcacaaaaacccgagcgcagtctcgtccccggtcccccggcggccccagcttacccagcactgagagccgggtcccggcgccgaagtactgaatgttttgtcgaccactgtactatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaacactgtactatcgctcctgagcgggctggcaaggc

SEQ ID NO: 50 - DNA, 495 bp, Artificial Sequence
  Oligonucleotide
gcctccctcgcgccatcaggatgatcctatcgctcccccgcaaaaaccagacccaagccgcccgcgcccgcgccccagcagcccgcgctcaccgagcaccaggagccgcgtgcctggcccgaagtactgggtctcgtcgacgatgatcctatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaagatgatcctatcgctcctgagcgggctggcaaggc

SEQ ID NO: 51 - DNA, 495 bp, Artificial Sequence
  Oligonucleotide
gcctccctcgcgccatcagcgccaatatatcgctcccgccgccttccacctgaatcccgccgcccgggtggtcccgcgaaaactcacccagcacggtcagcctgctgccggccccgaaagtcaggacgttggcccgtcgaccgccaatatatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaacgccaatatatcgctcctgagcgggctggcaaggc

SEQ ID NO: 52 - DNA, 495 bp, Artificial Sequence
  Oligonucleotide
gcctccctcgcgccatcagtcaagccttatcgctcccaccctccgactccggggaccgaggggctggaaggtggggagacgcccgaatctcacctgtgaccgtgagcctggtgcccggcccgaagtactgctcgtgtcgactcaagccttatcgctctcactgctggcacagaaatacacagcagagtcaccaagctccagggaattgatgtgaagatttaaatgagctttgtctggagagtcaggtgagaagcgatttggaactgtttcatttaaaattggctccttgttactgtagataaacattgtcttcagaaatttcttagagtcctgtttataccaatacatagcattatggcccagattttgttctcatttaagagactccttttttcccatctgtgtgaccaggtattttggagtctgggaaacggctgtgtccagtggatctgtaaaggaatcaagccttatcgctcctgagcgggctggcaaggc

SEQ ID NO: 53 - DNA, 495 bp, Artificial Sequence
  Oligonucleotide
gcctccctcgcgccatcagagagtgtctcagatgcctgtggacccacttttccctgtgacggatctgcaaaagaacctgaaaaatgtcttacctacaactgtgagtctggtgccttgtccaaagaaagcttcagtgtcgacagagtgtctcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggaagagtgtctcagatgcctgagcgggctggcaaggc

SEQ ID NO: 54 - DNA, 495 bp, Artificial Sequence
  Oligonucleotide
gcctccctcgcgccatcaggttccgaatcagatgcatttcccaggacagagtcctccctcatcgcacccctcctagagacccccagccttacctacaacggttaacctggtccccgaaccgaaggtgtagccatagtcgacgttccgaatcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggagttccgaatcagatgcctgagcgggctggcaaggc

SEQ ID NO: 55 - DNA, 495 bp, Artificial Sequence
  Oligonucleotide
gcctccctcgcgccatcagcgttactttcagatgcctggattccagcccctttttgcaagttcccagctgtccagccttgacttactcacctacaacagtgagccaacttccctctccaaaatatatggtgtttcgtcgaccgttactttcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggacgttactttcagatgcctgagcgggctggcaaggc

SEQ ID NO: 56 - DNA, 495 bp, Artificial Sequence
  Oligonucleotide
gcctccctcgcgccatcagtaggagactcagatgcctcctggaactccgaccttatgatacactatcccgaaagaagtcttttacatacccaagacagagagctgggttccactgccaaaaaacagtttttcattgtcgactaggagactcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggataggagactcagatgcctgagcgggctggcaaggc

SEQ ID NO: 57 - DNA, 495 bp, Artificial Sequence
  Oligonucleotide
gcctccctcgcgccatcaggacactcttcagatgcagagaactctgccttcaagggacaatggccataccaccctgattctgcaacttacctaggatggagagtcgagtcccatcaccaaaatgctggggctgatgtcgacgacactcttcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggagacactcttcagatgcctgagcgggctggcaaggc

SEQ ID NO: 58 - DNA, 495 bp, Artificial Sequence
  Oligonucleotide
gcctccctcgcgccatcagttcggaactcagatgcatcattgcagtcaaacccaggcacccccgagtcaagagtggagcccccatacctgtcacagtgagcctggtcccgttcccaaagtggaggggtgaattatgtcgacttcggaactcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggattcggaactcagatgcctgagcgggctggcaaggc

SEQ ID NO: 59 - DNA, 495 bp, Artificial Sequence
  Oligonucleotide
gcctccctcgcgccatcagaagtaacgtcagatgcgggtcgtgcaggctgggctgctcaccctctctcccacctggagcccccttcttacctagcacggtgagccgtgtccctggcccgaagaactgctcattgtgtcgacaagtaacgtcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggaaagtaacgtcagatgcctgagcgggctggcaaggc

SEQ ID NO: 60 - DNA, 495 bp, Artificial Sequence
  Oligonucleotide
gcctccctcgcgccatcaggtctcctatcagatgccctctgcccatcccgccctctcggagctctccggagccccaaccgcctccttacccagtacggtcagcctagagccttctccaaaaaacagctccccggtgtcgacgtctcctatcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggagtctcctatcagatgcctgagcgggctggcaaggc

SEQ ID NO: 61 - DNA, 495 bp, Artificial Sequence
  Oligonucleotide
gcctccctcgcgccatcaggtagacactcagatgcgcgtcccggggcgccccctccccagttccggggcttcagcgggagcccccgcttaccgagcactgtcagccgggtgcctgggccaaaatactgcgtatctgtcgacgtagacactcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggagtagacactcagatgcctgagcgggctggcaaggc

SEQ ID NO: 62 - DNA, 495 bp, Artificial Sequence
  Oligonucleotide
gcctccctcgcgccatcagcactgtactcagatgccgcacaaaaacccgagcgcagtctcgtccccggtcccccggcggccccagcttacccagcactgagagccgggtcccggcgccgaagtactgaatgttttgtcgaccactgtactcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggacactgtactcagatgcctgagcgggctggcaaggc

SEQ ID NO: 63 - DNA, 495 bp, Artificial Sequence
  Oligonucleotide
gcctccctcgcgccatcaggatgatcctcagatgcccccgcaaaaaccagacccaagccgcccgcgcccgcgccccagcagcccgcgctcaccgagcaccaggagccgcgtgcctggcccgaagtactgggtctcgtcgacgatgatcctcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggagatgatcctcagatgcctgagcgggctggcaaggc

SEQ ID NO: 64 - DNA, 495 bp, Artificial Sequence
  Oligonucleotide
gcctccctcgcgccatcagcgccaatatcagatgcccgccgccttccacctgaatcccgccgcccgggtggtcccgcgaaaactcacccagcacggtcagcctgctgccggccccgaaagtcaggacgttggcccgtcgaccgccaatatcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggacgccaatatcagatgcctgagcgggctggcaaggc

SEQ ID NO: 65 - DNA, 495 bp, Artificial Sequence
  Oligonucleotide
gcctccctcgcgccatcagtcaagccttcagatgcccaccctccgactccggggaccgaggggctggaaggtggggagacgcccgaatctcacctgtgaccgtgagcctggtgcccggcccgaagtactgctcgtgtcgactcaagccttcagatgctcactgctggcgcagagatacagggctgagtcttctggctgcagggcgtgtaggtgaaggtttaagagagagctgttggggcattcaggtgagaagcgacttggcacactttcatttatagagagtttctcatagctgtagacaaacatgagctccggtggcttcttagctttctgcttgtaccaatacatagccctgtgccccatatgttgttcacatttcaaagacttcttatttgtcattcccatgaccaggtgttttggtgtctgggtaacttcagtgtctatgggaactgtaggaggatcaagccttcagatgcctgagcgggctggcaaggc

SEQ ID NO: 66 - DNA, 495 bp, Artificial Sequence
  Oligonucleotide
gcctccctcgcgccatcagagagtgtcgtgtagcactgtggacccacttttccctgtgacggatctgcaaaagaacctgaaaaatgtcttacctacaactgtgagtctggtgccttgtccaaagaaagcttcagtgtcgacagagtgtcgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggaagagtgtcgtgtagcactgagcgggctggcaaggc

SEQ ID NO: 67 - DNA, 495 bp, Artificial Sequence
  Oligonucleotide
gcctccctcgcgccatcaggttccgaagtgtagcaatttcccaggacagagtcctccctcatcgcacccctcctagagacccccagccttacctacaacggttaacctggtccccgaaccgaaggtgtagccatagtcgacgttccgaagtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggagttccgaagtgtagcactgagcgggctggcaaggc

SEQ ID NO: 68 - DNA, 495 bp, Artificial Sequence
  Oligonucleotide
gcctccctcgcgccatcagcgttacttgtgtagcactggattccagcccctttttgcaagttcccagctgtccagccttgacttactcacctacaacagtgagccaacttccctctccaaaatatatggtgtttcgtcgaccgttacttgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggacgttacttgtgtagcactgagcgggctggcaaggc

SEQ ID NO: 69 - DNA, 495 bp, Artificial Sequence
  Oligonucleotide
gcctccctcgcgccatcagtaggagacgtgtagcactcctggaactccgaccttatgatacactatcccgaaagaagtcttttacatacccaagacagagagctgggttccactgccaaaaaacagtttttcattgtcgactaggagacgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggataggagacgtgtagcactgagcgggctggcaaggc

SEQ ID NO: 70 - DNA, 495 bp, Artificial Sequence
  Oligonucleotide
gcctccctcgcgccatcaggacactctgtgtagcaagagaactctgccttcaagggacaatggccataccaccctgattctgcaacttacctaggatggagagtcgagtcccatcaccaaaatgctggggctgatgtcgacgacactctgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggagacactctgtgtagcactgagcgggctggcaaggc

SEQ ID NO: 71 - DNA, 495 bp, Artificial Sequence
  Oligonucleotide
gcctccctcgcgccatcagttcggaacgtgtagcaatcattgcagtcaaacccaggcacccccgagtcaagagtggagcccccatacctgtcacagtgagcctggtcccgttcccaaagtggaggggtgaattatgtcgacttcggaacgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggattcggaacgtgtagcactgagcgggctggcaaggc

SEQ ID NO: 72 - DNA, 495 bp, Artificial Sequence
  Oligonucleotide
gcctccctcgcgccatcagaagtaacggtgtagcagggtcgtgcaggctgggctgctcaccctctctcccacctggagcccccttcttacctagcacggtgagccgtgtccctggcccgaagaactgctcattgtgtcgacaagtaacggtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggaaagtaacggtgtagcactgagcgggctggcaaggc

SEQ ID NO: 73 - DNA, 495 bp, Artificial Sequence
  Oligonucleotide
gcctccctcgcgccatcaggtctcctagtgtagcacctctgcccatcccgccctctcggagctctccggagccccaaccgcctccttacccagtacggtcagcctagagccttctccaaaaaacagctccccggtgtcgacgtctcctagtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggagtctcctagtgtagcactgagcgggctggcaaggc

SEQ ID NO: 74 - DNA, 495 bp, Artificial Sequence
  Oligonucleotide
gcctccctcgcgccatcaggtagacacgtgtagcagcgtcccggggcgccccctccccagttccggggcttcagcgggagcccccgcttaccgagcactgtcagccgggtgcctgggccaaaatactgcgtatctgtcgacgtagacacgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggagtagacacgtgtagcactgagcgggctggcaaggc

SEQ ID NO: 75 - DNA, 495 bp, Artificial Sequence
  Oligonucleotide
gcctccctcgcgccatcagcactgtacgtgtagcacgcacaaaaacccgagcgcagtctcgtccccggtcccccggcggccccagcttacccagcactgagagccgggtcccggcgccgaagtactgaatgttttgtcgaccactgtacgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggacactgtacgtgtagcactgagcgggctggcaaggc

SEQ ID NO: 76 - DNA, 495 bp, Artificial Sequence
  Oligonucleotide
gcctccctcgcgccatcaggatgatccgtgtagcaccccgcaaaaaccagacccaagccgcccgcgcccgcgccccagcagcccgcgctcaccgagcaccaggagccgcgtgcctggcccgaagtactgggtctcgtcgacgatgatccgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggagatgatccgtgtagcactgagcgggctggcaaggc

SEQ ID NO: 77 - DNA, 495 bp, Artificial Sequence
  Oligonucleotide
gcctccctcgcgccatcagcgccaatagtgtagcaccgccgccttccacctgaatcccgccgcccgggtggtcccgcgaaaactcacccagcacggtcagcctgctgccggccccgaaagtcaggacgttggcccgtcgaccgccaatagtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggacgccaatagtgtagcactgagcgggctggcaaggc

SEQ ID NO: 78 - DNA, 495 bp, Artificial Sequence
  Oligonucleotide
gcctccctcgcgccatcagtcaagcctgtgtagcaccaccctccgactccggggaccgaggggctggaaggtggggagacgcccgaatctcacctgtgaccgtgagcctggtgcccggcccgaagtactgctcgtgtcgactcaagcctgtgtagcatcactgctggcacagagatacagggccgagtcttctggctgcagggtgtgtaggtgaaggaataagtgagagctgttggggcattcaggtgagaagcgacttggcacactgttgttttcagtctgttctttaaagttgtagacaaacatgagctccagtggcttcttagcactttgcttgtaccaatacatagcgttatgccccagatgttgttcacatttcaaagacttcttatttgtcattcccatgaccaggtgtcttggtgtctgcgtaactcccgtttccatggggactgcggggggatcaagcctgtgtagcactgagcgggctggcaaggc

SEQ ID NO: 79 - DNA, 495 bp, Artificial Sequence
  Oligonucleotide
gcctccctcgcgccatcagagagtgtctggcagttctgtggacccacttttccctgtgacggatctgcaaaagaacctgaaaaatgtcttacctacaactgtgagtctggtgccttgtccaaagaaagcttcagtgtcgacagagtgtctggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggaagagtgtctggcagttctgagcgggctggcaaggc

SEQ ID NO: 80 - DNA, 495 bp, Artificial Sequence
  Oligonucleotide
gcctccctcgcgccatcaggttccgaatggcagttatttcccaggacagagtcctccctcatcgcacccctcctagagacccccagccttacctacaacggttaacctggtccccgaaccgaaggtgtagccatagtcgacgttccgaatggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggagttccgaatggcagttctgagcgggctggcaaggc

SEQ ID NO: 81 - DNA, 495 bp, Artificial Sequence
  Oligonucleotide
gcctccctcgcgccatcagcgttactttggcagttctggattccagcccctttttgcaagttcccagctgtccagccttgacttactcacctacaacagtgagccaacttccctctccaaaatatatggtgtttcgtcgaccgttactttggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggacgttactttggcagttctgagcgggctggcaaggc

SEQ ID NO: 82 - DNA, 495 bp, Artificial Sequence
  Oligonucleotide
gcctccctcgcgccatcagtaggagactggcagttctcctggaactccgaccttatgatacactatcccgaaagaagtcttttacatacccaagacagagagctgggttccactgccaaaaaacagtttttcattgtcgactaggagactggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggataggagactggcagttctgagcgggctggcaaggc

SEQ ID NO: 83 - DNA, 495 bp, Artificial Sequence
  Oligonucleotide
gcctccctcgcgccatcaggacactcttggcagttagagaactctgccttcaagggacaatggccataccaccctgattctgcaacttacctaggatggagagtcgagtcccatcaccaaaatgctggggctgatgtcgacgacactcttggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggagacactcttggcagttctgagcgggctggcaaggc

SEQ ID NO: 84 - DNA, 495 bp, Artificial Sequence
  Oligonucleotide
gcctccctcgcgccatcagttcggaactggcagttatcattgcagtcaaacccaggcacccccgagtcaagagtggagcccccatacctgtcacagtgagcctggtcccgttcccaaagtggaggggtgaattatgtcgacttcggaactggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggattcggaactggcagttctgagcgggctggcaaggc

SEQ ID NO: 85 - DNA, 495 bp, Artificial Sequence
  Oligonucleotide
gcctccctcgcgccatcagaagtaacgtggcagttgggtcgtgcaggctgggctgctcaccctctctcccacctggagcccccttcttacctagcacggtgagccgtgtccctggcccgaagaactgctcattgtgtcgacaagtaacgtggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggaaagtaacgtggcagttctgagcgggctggcaaggc

SEQ ID NO: 86 - DNA, 495 bp, Artificial Sequence
  Oligonucleotide
gcctccctcgcgccatcaggtctcctatggcagttcctctgcccatcccgccctctcggagctctccggagccccaaccgcctccttacccagtacggtcagcctagagccttctccaaaaaacagctccccggtgtcgacgtctcctatggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggagtctcctatggcagttctgagcgggctggcaaggc

SEQ ID NO: 87 - DNA, 495 bp, Artificial Sequence
  Oligonucleotide
gcctccctcgcgccatcaggtagacactggcagttgcgtcccggggcgccccctccccagttccggggcttcagcgggagcccccgcttaccgagcactgtcagccgggtgcctgggccaaaatactgcgtatctgtcgacgtagacactggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggagtagacactggcagttctgagcgggctggcaaggc

SEQ ID NO: 88 - DNA, 495 bp, Artificial Sequence
  Oligonucleotide
gcctccctcgcgccatcagcactgtactggcagttcgcacaaaaacccgagcgcagtctcgtccccggtcccccggcggccccagcttacccagcactgagagccgggtcccggcgccgaagtactgaatgttttgtcgaccactgtactggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggacactgtactggcagttctgagcgggctggcaaggc

SEQ ID NO: 89 - DNA, 495 bp, Artificial Sequence
  Oligonucleotide
gcctccctcgcgccatcaggatgatcctggcagttccccgcaaaaaccagacccaagccgcccgcgcccgcgccccagcagcccgcgctcaccgagcaccaggagccgcgtgcctggcccgaagtactgggtctcgtcgacgatgatcctggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggagatgatcctggcagttctgagcgggctggcaaggc

SEQ ID NO: 90 - DNA, 495 bp, Artificial Sequence
  Oligonucleotide
gcctccctcgcgccatcagcgccaatatggcagttccgccgccttccacctgaatcccgccgcccgggtggtcccgcgaaaactcacccagcacggtcagcctgctgccggccccgaaagtcaggacgttggcccgtcgaccgccaatatggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggacgccaatatggcagttctgagcgggctggcaaggc

SEQ ID NO: 91 - DNA, 495 bp, Artificial Sequence
  Oligonucleotide
gcctccctcgcgccatcagtcaagccttggcagttccaccctccgactccggggaccgaggggctggaaggtggggagacgcccgaatctcacctgtgaccgtgagcctggtgcccggcccgaagtactgctcgtgtcgactcaagccttggcagtttcactgctggcgcagagatacagggccgagtcttctggctgcagggtgtgtaggtgaaggaataagtgagagctgttggggcattcaggtgagaagcgacttggcacactgttgttttcaacccgttcttcaagactgtagacaaacatgagctccagtggcttcttagcactttgcttgtaccaatacatagcgttatgacccagatgttgttcacatttcaaagacttcttatttgtcattcccatgaccaggtgtcttggtgtctgcgtaactcccgtttccatggggactgtggggggatcaagccttggcagttctgagcgggctggcaaggc

SEQ ID NO: 92 - DNA, 495 bp, Artificial Sequence
  Oligonucleotide
gcctccctcgcgccatcagagagtgtccagtccaactgtggacccacttttccctgtgacggatctgcaaaagaacctgaaaaatgtcttacctacaactgtgagtctggtgccttgtccaaagaaagcttcagtgtcgacagagtgtccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagagagtgtccagtccaactgagcgggctggcaaggc

SEQ ID NO: 93 - DNA, 495 bp, Artificial Sequence
  Oligonucleotide
gcctccctcgcgccatcaggttccgaacagtccaaatttcccaggacagagtcctccctcatcgcacccctcctagagacccccagccttacctacaacggttaacctggtccccgaaccgaaggtgtagccatagtcgacgttccgaacagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaaggttccgaacagtccaactgagcgggctggcaaggc

SEQ ID NO: 94 - DNA, 495 bp, Artificial Sequence
  Oligonucleotide
gcctccctcgcgccatcagcgttacttcagtccaactggattccagcccctttttgcaagttcccagctgtccagccttgacttactcacctacaacagtgagccaacttccctctccaaaatatatggtgtttcgtcgaccgttacttcagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagcgttacttcagtccaactgagcgggctggcaaggc

SEQ ID NO: 95 - DNA, 495 bp, Artificial Sequence
  Oligonucleotide
gcctccctcgcgccatcagtaggagaccagtccaactcctggaactccgaccttatgatacactatcccgaaagaagtcttttacatacccaagacagagagctgggttccactgccaaaaaacagtttttcattgtcgactaggagaccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagtaggagaccagtccaactgagcgggctggcaaggc

SEQ ID NO: 96 - DNA, 495 bp, Artificial Sequence
  Oligonucleotide
gcctccctcgcgccatcaggacactctcagtccaaagagaactctgccttcaagggacaatggccataccaccctgattctgcaacttacctaggatggagagtcgagtcccatcaccaaaatgctggggctgatgtcgacgacactctcagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaaggacactctcagtccaactgagcgggctggcaaggc

SEQ ID NO: 97 - DNA, 495 bp, Artificial Sequence
  Oligonucleotide
gcctccctcgcgccatcagttcggaaccagtccaaatcattgcagtcaaacccaggcacccccgagtcaagagtggagcccccatacctgtcacagtgagcctggtcccgttcccaaagtggaggggtgaattatgtcgacttcggaaccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagttcggaaccagtccaactgagcgggctggcaaggc

SEQ ID NO: 98 - DNA, 495 bp, Artificial Sequence
  Oligonucleotide
gcctccctcgcgccatcagaagtaacgcagtccaagggtcgtgcaggctgggctgctcaccctctctcccacctggagcccccttcttacctagcacggtgagccgtgtccctggcccgaagaactgctcattgtgtcgacaagtaacgcagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagaagtaacgcagtccaactgagcgggctggcaaggc

SEQ ID NO: 99 - DNA, 495 bp, Artificial Sequence
  Oligonucleotide
gcctccctcgcgccatcaggtctcctacagtccaacctctgcccatcccgccctctcggagctctccggagccccaaccgcctccttacccagtacggtcagcctagagccttctccaaaaaacagctccccggtgtcgacgtctcctacagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaaggtctcctacagtccaactgagcgggctggcaaggc

SEQ ID NO: 100 - DNA, 495 bp, Artificial Sequence
  Oligonucleotide
gcctccctcgcgccatcaggtagacaccagtccaagcgtcccggggcgccccctccccagttccggggcttcagcgggagcccccgcttaccgagcactgtcagccgggtgcctgggccaaaatactgcgtatctgtcgacgtagacaccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaaggtagacaccagtccaactgagcgggctggcaaggc

SEQ ID NO: 101 - DNA, 495 bp, Artificial Sequence
  Oligonucleotide
gcctccctcgcgccatcagcactgtaccagtccaacgcacaaaaacccgagcgcagtctcgtccccggtcccccggcggccccagcttacccagcactgagagccgggtcccggcgccgaagtactgaatgttttgtcgaccactgtaccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagcactgtaccagtccaactgagcgggctggcaaggc

SEQ ID NO: 102 - DNA, 495 bp, Artificial Sequence
  Oligonucleotide
gcctccctcgcgccatcaggatgatcccagtccaaccccgcaaaaaccagacccaagccgcccgcgcccgcgccccagcagcccgcgctcaccgagcaccaggagccgcgtgcctggcccgaagtactgggtctcgtcgacgatgatcccagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaaggatgatcccagtccaactgagcgggctggcaaggc

SEQ ID NO: 103 - DNA, 495 bp, Artificial Sequence
  Oligonucleotide
gcctccctcgcgccatcagcgccaatacagtccaaccgccgccttccacctgaatcccgccgcccgggtggtcccgcgaaaactcacccagcacggtcagcctgctgccggccccgaaagtcaggacgttggcccgtcgaccgccaatacagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagcgccaatacagtccaactgagcgggctggcaaggc

SEQ ID NO: 104 - DNA, 495 bp, Artificial Sequence
  Oligonucleotide
gcctccctcgcgccatcagtcaagcctcagtccaaccaccctccgactccggggaccgaggggctggaaggtggggagacgcccgaatctcacctgtgaccgtgagcctggtgcccggcccgaagtactgctcgtgtcgactcaagcctcagtccaatcatgctggcgcaaagataaagggccgagtcccccagctccaaggtgctcacattcatctcagagcgagagttagagaactggcgccctgagaatcgaccagggaagtttcctttgtttctctgtgtctcactgaagtattcaaagaggaactgaaggccctgtcctggggtctgttggtaccaggatacactcctatgcccagagataggggagcagctcagtgtcacttgctgtcctctcgttttgatcagatatcttggagtttgagtgactccagcctttactgggcctgtgggaaaagtcaagcctcagtccaactgagcgggctggcaaggc

SEQ ID NO: 105 - DNA, 495 bp, Artificial Sequence
  Oligonucleotide
gcctccctcgcgccatcagagagtgtcgtgtctacctgtggacccacttttccctgtgacggatctgcaaaagaacctgaaaaatgtcttacctacaactgtgagtctggtgccttgtccaaagaaagcttcagtgtcgacagagtgtcgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaaagagtgtcgtgtctacctgagcgggctggcaaggc

SEQ ID NO: 106 - DNA, 495 bp, Artificial Sequence
  Oligonucleotide
gcctccctcgcgccatcaggttccgaagtgtctacatttcccaggacagagtcctccctcatcgcacccctcctagagacccccagccttacctacaacggttaacctggtccccgaaccgaaggtgtagccatagtcgacgttccgaagtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaagttccgaagtgtctacctgagcgggctggcaaggc

SEQ ID NO: 107 - DNA, 495 bp, Artificial Sequence
  Oligonucleotide
gcctccctcgcgccatcagcgttacttgtgtctacctggattccagcccctttttgcaagttcccagctgtccagccttgacttactcacctacaacagtgagccaacttccctctccaaaatatatggtgtttcgtcgaccgttacttgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaacgttacttgtgtctacctgagcgggctggcaaggc

SEQ ID NO: 108 - DNA, 495 bp, Artificial Sequence
  Oligonucleotide
gcctccctcgcgccatcagtaggagacgtgtctacctcctggaactccgaccttatgatacactatcccgaaagaagtcttttacatacccaagacagagagctgggttccactgccaaaaaacagtttttcattgtcgactaggagacgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaataggagacgtgtctacctgagcgggctggcaaggc

SEQ ID NO: 109 - DNA, 495 bp, Artificial Sequence
  Oligonucleotide
gcctccctcgcgccatcaggacactctgtgtctacagagaactctgccttcaagggacaatggccataccaccctgattctgcaacttacctaggatggagagtcgagtcccatcaccaaaatgctggggctgatgtcgacgacactctgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaagacactctgtgtctacctgagcgggctggcaaggc

SEQ ID NO: 110 - DNA, 495 bp, Artificial Sequence
  Oligonucleotide
gcctccctcgcgccatcagttcggaacgtgtctacatcattgcagtcaaacccaggcacccccgagtcaagagtggagcccccatacctgtcacagtgagcctggtcccgttcccaaagtggaggggtgaattatgtcgacttcggaacgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaattcggaacgtgtctacctgagcgggctggcaaggc

SEQ ID NO: 111 - DNA, 495 bp, Artificial Sequence
  Oligonucleotide
gcctccctcgcgccatcagaagtaacggtgtctacgggtcgtgcaggctgggctgctcaccctctctcccacctggagcccccttcttacctagcacggtgagccgtgtccctggcccgaagaactgctcattgtgtcgacaagtaacggtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaaaagtaacggtgtctacctgagcgggctggcaaggc

SEQ ID NO: 112 - DNA, 495 bp, Artificial Sequence
  Oligonucleotide
gcctccctcgcgccatcaggtctcctagtgtctaccctctgcccatcccgccctctcggagctctccggagccccaaccgcctccttacccagtacggtcagcctagagccttctccaaaaaacagctccccggtgtcgacgtctcctagtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaagtctcctagtgtctacctgagcgggctggcaaggc

SEQ ID NO: 113 - DNA, 495 bp, Artificial Sequence
  Oligonucleotide
gcctccctcgcgccatcaggtagacacgtgtctacgcgtcccggggcgccccctccccagttccggggcttcagcgggagcccccgcttaccgagcactgtcagccgggtgcctgggccaaaatactgcgtatctgtcgacgtagacacgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaagtagacacgtgtctacctgagcgggctggcaaggc

SEQ ID NO: 114 - DNA, 495 bp, Artificial Sequence
  Oligonucleotide
gcctccctcgcgccatcagcactgtacgtgtctaccgcacaaaaacccgagcgcagtctcgtccccggtcccccggcggccccagcttacccagcactgagagccgggtcccggcgccgaagtactgaatgttttgtcgaccactgtacgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaacactgtacgtgtctacctgagcgggctggcaaggc

SEQ ID NO: 115 - DNA, 495 bp, Artificial Sequence
  Oligonucleotide
gcctccctcgcgccatcaggatgatccgtgtctacccccgcaaaaaccagacccaagccgcccgcgcccgcgccccagcagcccgcgctcaccgagcaccaggagccgcgtgcctggcccgaagtactgggtctcgtcgacgatgatccgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaagatgatccgtgtctacctgagcgggctggcaaggc

SEQ ID NO: 116 - DNA, 495 bp, Artificial Sequence
  Oligonucleotide
gcctccctcgcgccatcagcgccaatagtgtctacccgccgccttccacctgaatcccgccgcccgggtggtcccgcgaaaactcacccagcacggtcagcctgctgccggccccgaaagtcaggacgttggcccgtcgaccgccaatagtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaacgccaatagtgtctacctgagcgggctggcaaggc

SEQ ID NO: 117 - DNA, 495 bp, Artificial Sequence
  Oligonucleotide
gcctccctcgcgccatcagtcaagcctgtgtctacccaccctccgactccggggaccgaggggctggaaggtggggagacgcccgaatctcacctgtgaccgtgagcctggtgcccggcccgaagtactgctcgtgtcgactcaagcctgtgtctactcatgctggcacagagatacagggctgagtcccctagctccgtgtttgactcagtaatagttatggacgtggtgagctgagaatcaattaggcaagtttccttttgctctttgtaacctattacaatattgtaacaataactagaggggctgacttggagttcgtaggtaccaggacacacagttatgcccagaggcaggggagcatctcagtgtcacttgctggtctcttgttttgatcaggtgtcttggagcttgggtgattccagcctccactgggcctgaggaaaaaataggtggagaatcaagcctgtgtctacctgagcgggctggcaaggc

SEQ ID NO: 118 - DNA, 495 bp, Artificial Sequence
  Oligonucleotide
gcctccctcgcgccatcagagagtgtcgtacagtgctgtggacccacttttccctgtgacggatctgcaaaagaacctgaaaaatgtcttacctacaactgtgagtctggtgccttgtccaaagaaagcttcagtgtcgacagagtgtcgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagagagtgtcgtacagtgctgagcgggctggcaaggc

SEQ ID NO: 119 - DNA, 495 bp, Artificial Sequence
  Oligonucleotide
gcctccctcgcgccatcaggttccgaagtacagtgatttcccaggacagagtcctccctcatcgcacccctcctagagacccccagccttacctacaacggttaacctggtccccgaaccgaaggtgtagccatagtcgacgttccgaagtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaaggttccgaagtacagtgctgagcgggctggcaaggc

SEQ ID NO: 120 - DNA, 495 bp, Artificial Sequence
  Oligonucleotide
gcctccctcgcgccatcagcgttacttgtacagtgctggattccagcccctttttgcaagttcccagctgtccagccttgacttactcacctacaacagtgagccaacttccctctccaaaatatatggtgtttcgtcgaccgttacttgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagcgttacttgtacagtgctgagcgggctggcaaggc

SEQ ID NO: 121 - DNA, 495 bp, Artificial Sequence
  Oligonucleotide
gcctccctcgcgccatcagtaggagacgtacagtgctcctggaactccgaccttatgatacactatcccgaaagaagtcttttacatacccaagacagagagctgggttccactgccaaaaaacagtttttcattgtcgactaggagacgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagtaggagacgtacagtgctgagcgggctggcaaggc

SEQ ID NO: 122 - DNA, 495 bp, Artificial Sequence
  Oligonucleotide
gcctccctcgcgccatcaggacactctgtacagtgagagaactctgccttcaagggacaatggccataccaccctgattctgcaacttacctaggatggagagtcgagtcccatcaccaaaatgctggggctgatgtcgacgacactctgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaaggacactctgtacagtgctgagcgggctggcaaggc

SEQ ID NO: 123 - DNA, 495 bp, Artificial Sequence
  Oligonucleotide
gcctccctcgcgccatcagttcggaacgtacagtgatcattgcagtcaaacccaggcacccccgagtcaagagtggagcccccatacctgtcacagtgagcctggtcccgttcccaaagtggaggggtgaattatgtcgacttcggaacgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagttcggaacgtacagtgctgagcgggctggcaaggc

SEQ ID NO: 124 - DNA, 495 bp, Artificial Sequence
  Oligonucleotide
gcctccctcgcgccatcagaagtaacggtacagtggggtcgtgcaggctgggctgctcaccctctctcccacctggagcccccttcttacctagcacggtgagccgtgtccctggcccgaagaactgctcattgtgtcgacaagtaacggtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagaagtaacggtacagtgctgagcgggctggcaaggc

SEQ ID NO: 125 - DNA, 495 bp, Artificial Sequence
  Oligonucleotide
gcctccctcgcgccatcaggtctcctagtacagtgcctctgcccatcccgccctctcggagctctccggagccccaaccgcctccttacccagtacggtcagcctagagccttctccaaaaaacagctccccggtgtcgacgtctcctagtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaaggtctcctagtacagtgctgagcgggctggcaaggc

SEQ ID NO: 126 - DNA, 495 bp, Artificial Sequence
  Oligonucleotide
gcctccctcgcgccatcaggtagacacgtacagtggcgtcccggggcgccccctccccagttccggggcttcagcgggagcccccgcttaccgagcactgtcagccgggtgcctgggccaaaatactgcgtatctgtcgacgtagacacgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaaggtagacacgtacagtgctgagcgggctggcaaggc

SEQ ID NO: 127 - DNA, 495 bp, Artificial Sequence
  Oligonucleotide
gcctccctcgcgccatcagcactgtacgtacagtgcgcacaaaaacccgagcgcagtctcgtccccggtcccccggcggccccagcttacccagcactgagagccgggtcccggcgccgaagtactgaatgttttgtcgaccactgtacgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagcactgtacgtacagtgctgagcgggctggcaaggc

SEQ ID NO: 128 - DNA, 495 bp, Artificial Sequence
  Oligonucleotide
gcctccctcgcgccatcaggatgatccgtacagtgccccgcaaaaaccagacccaagccgcccgcgcccgcgccccagcagcccgcgctcaccgagcaccaggagccgcgtgcctggcccgaagtactgggtctcgtcgacgatgatccgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaaggatgatccgtacagtgctgagcgggctggcaaggc

SEQ ID NO: 129 - DNA, 495 bp, Artificial Sequence
  Oligonucleotide
gcctccctcgcgccatcagcgccaatagtacagtgccgccgccttccacctgaatcccgccgcccgggtggtcccgcgaaaactcacccagcacggtcagcctgctgccggccccgaaagtcaggacgttggcccgtcgaccgccaatagtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagcgccaatagtacagtgctgagcgggctggcaaggc

SEQ ID NO: 130 - DNA, 495 bp, Artificial Sequence
  Oligonucleotide
gcctccctcgcgccatcagtcaagcctgtacagtgccaccctccgactccggggaccgaggggctggaaggtggggagacgcccgaatctcacctgtgaccgtgagcctggtgcccggcccgaagtactgctcgtgtcgactcaagcctgtacagtgtcattctggcacagagatacagggccgagtcccccagctccaaggcactcacattcatctcagagcaacagtcatggaactggcgccctgagaatcgattagggaagtttccttctgatctccttaactcattagcatattcaaagataaactggggcccctgacccggggcctgttggtaccaggacacactgctgtgcccagagataggagagcatctcagagtcacttgctgtcctctcgttttgatcaggtgtgtgggactttgggtgactccagcctccactgggcctgtgggaaaagtcaagcctgtacagtgctgagcgggctggcaaggc

SEQ ID NO: 131 - DNA, 495 bp, Artificial Sequence
  Oligonucleotide
gcctccctcgcgccatcagagagtgtcggatcatcctgtggacccacttttccctgtgacggatctgcaaaagaacctgaaaaatgtcttacctacaactgtgagtctggtgccttgtccaaagaaagcttcagtgtcgacagagtgtcggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagagagtgtcggatcatcctgagcgggctggcaaggc

SEQ ID NO: 132 - DNA, 495 bp, Artificial Sequence
  Oligonucleotide
gcctccctcgcgccatcaggttccgaaggatcatcatttcccaggacagagtcctccctcatcgcacccctcctagagacccccagccttacctacaacggttaacctggtccccgaaccgaaggtgtagccatagtcgacgttccgaaggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaaggttccgaaggatcatcctgagcgggctggcaaggc

SEQ ID NO: 133 - DNA, 495 bp, Artificial Sequence
  Oligonucleotide
gcctccctcgcgccatcagcgttacttggatcatcctggattccagcccctttttgcaagttcccagctgtccagccttgacttactcacctacaacagtgagccaacttccctctccaaaatatatggtgtttcgtcgaccgttacttggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagcgttacttggatcatcctgagcgggctggcaaggc

SEQ ID NO: 134 - DNA, 495 bp, Artificial Sequence
  Oligonucleotide
gcctccctcgcgccatcagtaggagacggatcatcctcctggaactccgaccttatgatacactatcccgaaagaagtcttttacatacccaagacagagagctgggttccactgccaaaaaacagtttttcattgtcgactaggagacggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagtaggagacggatcatcctgagcgggctggcaaggc

SEQ ID NO: 135 - DNA, 495 bp, Artificial Sequence
  Oligonucleotide
gcctccctcgcgccatcaggacactctggatcatcagagaactctgccttcaagggacaatggccataccaccctgattctgcaacttacctaggatggagagtcgagtcccatcaccaaaatgctggggctgatgtcgacgacactctggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaaggacactctggatcatcctgagcgggctggcaaggc

SEQ ID NO: 136 - DNA, 495 bp, Artificial Sequence
  Oligonucleotide
gcctccctcgcgccatcagttcggaacggatcatcatcattgcagtcaaacccaggcacccccgagtcaagagtggagcccccatacctgtcacagtgagcctggtcccgttcccaaagtggaggggtgaattatgtcgacttcggaacggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagttcggaacggatcatcctgagcgggctggcaaggc

SEQ ID NO: 137 - DNA, 495 bp, Artificial Sequence
  Oligonucleotide
gcctccctcgcgccatcagaagtaacgggatcatcgggtcgtgcaggctgggctgctcaccctctctcccacctggagcccccttcttacctagcacggtgagccgtgtccctggcccgaagaactgctcattgtgtcgacaagtaacgggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagaagtaacgggatcatcctgagcgggctggcaaggc

SEQ ID NO: 138 - DNA, 495 bp, Artificial Sequence
  Oligonucleotide
gcctccctcgcgccatcaggtctcctaggatcatccctctgcccatcccgccctctcggagctctccggagccccaaccgcctccttacccagtacggtcagcctagagccttctccaaaaaacagctccccggtgtcgacgtctcctaggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaaggtctcctaggatcatcctgagcgggctggcaaggc

SEQ ID NO: 139 - DNA, 495 bp, Artificial Sequence
  Oligonucleotide
gcctccctcgcgccatcaggtagacacggatcatcgcgtcccggggcgccccctccccagttccggggcttcagcgggagcccccgcttaccgagcactgtcagccgggtgcctgggccaaaatactgcgtatctgtcgacgtagacacggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaaggtagacacggatcatcctgagcgggctggcaaggc

SEQ ID NO: 140 - DNA, 495 bp, Artificial Sequence
  Oligonucleotide
gcctccctcgcgccatcagcactgtacggatcatccgcacaaaaacccgagcgcagtctcgtccccggtcccccggcggccccagcttacccagcactgagagccgggtcccggcgccgaagtactgaatgttttgtcgaccactgtacggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagcactgtacggatcatcctgagcgggctggcaaggc

SEQ ID NO: 141 - DNA, 495 bp, Artificial Sequence
  Oligonucleotide
gcctccctcgcgccatcaggatgatccggatcatcccccgcaaaaaccagacccaagccgcccgcgcccgcgccccagcagcccgcgctcaccgagcaccaggagccgcgtgcctggcccgaagtactgggtctcgtcgacgatgatccggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaaggatgatccggatcatcctgagcgggctggcaaggc

SEQ ID NO: 142 - DNA, 495 bp, Artificial Sequence
  Oligonucleotide
gcctccctcgcgccatcagcgccaataggatcatcccgccgccttccacctgaatcccgccgcccgggtggtcccgcgaaaactcacccagcacggtcagcctgctgccggccccgaaagtcaggacgttggcccgtcgaccgccaataggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagcgccaataggatcatcctgagcgggctggcaaggc

SEQ ID NO: 143 - DNA, 495 bp, Artificial Sequence
  Oligonucleotide
gcctccctcgcgccatcagtcaagcctggatcatcccaccctccgactccggggaccgaggggctggaaggtggggagacgcccgaatctcacctgtgaccgtgagcctggtgcccggcccgaagtactgctcgtgtcgactcaagcctggatcatctcatgctggcacagagatacagggccgagtcgtccagctccaaggcgttcacattcagctcagagctataattagggaactggagacctgagaatctaggagggaagtttcctctgccattctcttcctccctataatactgaaagataaactggggcccctgacccagggcctgttggtaccaggacacagtgttgtgcccagactgagaagagcatctcagagtcacttgctgtcctctcgttttgatcaggtgtgtgggactttgggtgactccagtctccactgagcctgtgggaaaagtcaagcctggatcatcctgagcgggctggcaaggc

SEQ ID NO: 144 - DNA, 495 bp, Artificial Sequence
  Oligonucleotide
gcctccctcgcgccatcagagagtgtctattggcgctgtggacccacttttccctgtgacggatctgcaaaagaacctgaaaaatgtcttacctacaactgtgagtctggtgccttgtccaaagaaagcttcagtgtcgacagagtgtctattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagagagtgtctattggcgctgagcgggctggcaaggc

SEQ ID NO: 145 - DNA, 495 bp, Artificial Sequence
  Oligonucleotide
gcctccctcgcgccatcaggttccgaatattggcgatttcccaggacagagtcctccctcatcgcacccctcctagagacccccagccttacctacaacggttaacctggtccccgaaccgaaggtgtagccatagtcgacgttccgaatattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaaggttccgaatattggcgctgagcgggctggcaaggc

SEQ ID NO: 146 - DNA, 495 bp, Artificial Sequence
  Oligonucleotide
gcctccctcgcgccatcagcgttactttattggcgctggattccagcccctttttgcaagttcccagctgtccagccttgacttactcacctacaacagtgagccaacttccctctccaaaatatatggtgtttcgtcgaccgttactttattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagcgttactttattggcgctgagcgggctggcaaggc

SEQ ID NO: 147 - DNA, 495 bp, Artificial Sequence
  Oligonucleotide
gcctccctcgcgccatcagtaggagactattggcgctcctggaactccgaccttatgatacactatcccgaaagaagtcttttacatacccaagacagagagctgggttccactgccaaaaaacagtttttcattgtcgactaggagactattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagtaggagactattggcgctgagcgggctggcaaggc

SEQ ID NO: 148 - DNA, 495 bp, Artificial Sequence
  Oligonucleotide
gcctccctcgcgccatcaggacactcttattggcgagagaactctgccttcaagggacaatggccataccaccctgattctgcaacttacctaggatggagagtcgagtcccatcaccaaaatgctggggctgatgtcgacgacactcttattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaaggacactcttattggcgctgagcgggctggcaaggc

SEQ ID NO: 149 - DNA, 495 bp, Artificial Sequence
  Oligonucleotide
gcctccctcgcgccatcagttcggaactattggcgatcattgcagtcaaacccaggcacccccgagtcaagagtggagcccccatacctgtcacagtgagcctggtcccgttcccaaagtggaggggtgaattatgtcgacttcggaactattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagttcggaactattggcgctgagcgggctggcaaggc

SEQ ID NO: 150 - DNA, 495 bp, Artificial Sequence
  Oligonucleotide
gcctccctcgcgccatcagaagtaacgtattggcggggtcgtgcaggctgggctgctcaccctctctcccacctggagcccccttcttacctagcacggtgagccgtgtccctggcccgaagaactgctcattgtgtcgacaagtaacgtattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagaagtaacgtattggcgctgagcgggctggcaaggc

SEQ ID NO: 151 - DNA, 495 bp, Artificial Sequence
  Oligonucleotide
gcctccctcgcgccatcaggtctcctatattggcgcctctgcccatcccgccctctcggagctctccggagccccaaccgcctccttacccagtacggtcagcctagagccttctccaaaaaacagctccccggtgtcgacgtctcctatattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaaggtctcctatattggcgctgagcgggctggcaaggc

SEQ ID NO: 152 - DNA, 495 bp, Artificial Sequence
  Oligonucleotide
gcctccctcgcgccatcaggtagacactattggcggcgtcccggggcgccccctccccagttccggggcttcagcgggagcccccgcttaccgagcactgtcagccgggtgcctgggccaaaatactgcgtatctgtcgacgtagacactattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaaggtagacactattggcgctgagcgggctggcaaggc

SEQ ID NO: 153 - DNA, 495 bp, Artificial Sequence
  Oligonucleotide
gcctccctcgcgccatcagcactgtactattggcgcgcacaaaaacccgagcgcagtctcgtccccggtcccccggcggccccagcttacccagcactgagagccgggtcccggcgccgaagtactgaatgttttgtcgaccactgtactattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagcactgtactattggcgctgagcgggctggcaaggc

SEQ ID NO: 154 - DNA, 495 bp, Artificial Sequence
  Oligonucleotide
gcctccctcgcgccatcaggatgatcctattggcgccccgcaaaaaccagacccaagccgcccgcgcccgcgccccagcagcccgcgctcaccgagcaccaggagccgcgtgcctggcccgaagtactgggtctcgtcgacgatgatcctattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaaggatgatcctattggcgctgagcgggctggcaaggc

SEQ ID NO: 155 - DNA, 495 bp, Artificial Sequence
  Oligonucleotide
gcctccctcgcgccatcagcgccaatatattggcgccgccgccttccacctgaatcccgccgcccgggtggtcccgcgaaaactcacccagcacggtcagcctgctgccggccccgaaagtcaggacgttggcccgtcgaccgccaatatattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagcgccaatatattggcgctgagcgggctggcaaggc

SEQ ID NO: 156 - DNA, 495 bp, Artificial Sequence
  Oligonucleotide
gcctccctcgcgccatcagtcaagccttattggcgccaccctccgactccggggaccgaggggctggaaggtggggagacgcccgaatctcacctgtgaccgtgagcctggtgcccggcccgaagtactgctcgtgtcgactcaagccttattggcgtcatgctggcacagagatacagggccgagtcccccagcaacaaggcgttcacattcagctcagagctatagttagggaactggcgagctgagaatcgatcagggaagtttcctcttcctctctcttctttctcataatactgaaagataaactggggcccctgacccaggacctgttggtaccaggacacactcttgtgcccagagataggagagcatctcagagtcacttgctgtcctctcgttttgatcaggtgtgtgggactttgggtgactccagcgtccactgggcctgtgggaaaagtcaagccttattggcgctgagcgggctggcaaggc

SEQ ID NO: 157 - DNA, 495 bp, Artificial Sequence
  Oligonucleotide
gcctccctcgcgccatcagagagtgtcaggcttgactgtggacccacttttccctgtgacggatctgcaaaagaacctgaaaaatgtcttacctacaactgtgagtctggtgccttgtccaaagaaagcttcagtgtcgacagagtgtcaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagagagtgtcaggcttgactgagcgggctggcaaggc

SEQ ID NO: 158 - DNA, 495 bp, Artificial Sequence
  Oligonucleotide
gcctccctcgcgccatcaggttccgaaaggcttgaatttcccaggacagagtcctccctcatcgcacccctcctagagacccccagccttacctacaacggttaacctggtccccgaaccgaaggtgtagccatagtcgacgttccgaaaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaaggttccgaaaggcttgactgagcgggctggcaaggc

SEQ ID NO: 159 - DNA, 495 bp, Artificial Sequence
  Oligonucleotide
gcctccctcgcgccatcagcgttacttaggcttgactggattccagcccctttttgcaagttcccagctgtccagccttgacttactcacctacaacagtgagccaacttccctctccaaaatatatggtgtttcgtcgaccgttacttaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagcgttacttaggcttgactgagcgggctggcaaggc

SEQ ID NO: 160 - DNA, 495 bp, Artificial Sequence
  Oligonucleotide
gcctccctcgcgccatcagtaggagacaggcttgactcctggaactccgaccttatgatacactatcccgaaagaagtcttttacatacccaagacagagagctgggttccactgccaaaaaacagtttttcattgtcgactaggagacaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagtaggagacaggcttgactgagcgggctggcaaggc

SEQ ID NO: 161 - DNA, 495 bp, Artificial Sequence
  Oligonucleotide
gcctccctcgcgccatcaggacactctaggcttgaagagaactctgccttcaagggacaatggccataccaccctgattctgcaacttacctaggatggagagtcgagtcccatcaccaaaatgctggggctgatgtcgacgacactctaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaaggacactctaggcttgactgagcgggctggcaaggc

SEQ ID NO: 162 - DNA, 495 bp, Artificial Sequence
  Oligonucleotide
gcctccctcgcgccatcagttcggaacaggcttgaatcattgcagtcaaacccaggcacccccgagtcaagagtggagcccccatacctgtcacagtgagcctggtcccgttcccaaagtggaggggtgaattatgtcgacttcggaacaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagttcggaacaggcttgactgagcgggctggcaaggc

SEQ ID NO: 163 - DNA, 495 bp, Artificial Sequence
  Oligonucleotide
gcctccctcgcgccatcagaagtaacgaggcttgagggtcgtgcaggctgggctgctcaccctctctcccacctggagcccccttcttacctagcacggtgagccgtgtccctggcccgaagaactgctcattgtgtcgacaagtaacgaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagaagtaacgaggcttgactgagcgggctggcaaggc

SEQ ID NO: 164 - DNA, 495 bp, Artificial Sequence
  Oligonucleotide
gcctccctcgcgccatcaggtctcctaaggcttgacctctgcccatcccgccctctcggagctctccggagccccaaccgcctccttacccagtacggtcagcctagagccttctccaaaaaacagctccccggtgtcgacgtctcctaaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaaggtctcctaaggcttgactgagcgggctggcaaggc

SEQ ID NO: 165 - DNA, 495 bp, Artificial Sequence
  Oligonucleotide
gcctccctcgcgccatcaggtagacacaggcttgagcgtcccggggcgccccctccccagttccggggcttcagcgggagcccccgcttaccgagcactgtcagccgggtgcctgggccaaaatactgcgtatctgtcgacgtagacacaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaaggtagacacaggcttgactgagcgggctggcaaggc

SEQ ID NO: 166 - DNA, 495 bp, Artificial Sequence
  Oligonucleotide
gcctccctcgcgccatcagcactgtacaggcttgacgcacaaaaacccgagcgcagtctcgtccccggtcccccggcggccccagcttacccagcactgagagccgggtcccggcgccgaagtactgaatgttttgtcgaccactgtacaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagcactgtacaggcttgactgagcgggctggcaaggc

SEQ ID NO: 167 - DNA, 495 bp, Artificial Sequence
  Oligonucleotide
gcctccctcgcgccatcaggatgatccaggcttgaccccgcaaaaaccagacccaagccgcccgcgcccgcgccccagcagcccgcgctcaccgagcaccaggagccgcgtgcctggcccgaagtactgggtctcgtcgacgatgatccaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaaggatgatccaggcttgactgagcgggctggcaaggc

SEQ ID NO: 168 - DNA, 495 bp, Artificial Sequence
  Oligonucleotide
gcctccctcgcgccatcagcgccaataaggcttgaccgccgccttccacctgaatcccgccgcccgggtggtcccgcgaaaactcacccagcacggtcagcctgctgccggccccgaaagtcaggacgttggcccgtcgaccgccaataaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagcgccaataaggcttgactgagcgggctggcaaggc

SEQ ID NO: 169 - DNA, 495 bp, Artificial Sequence
  Oligonucleotide
gcctccctcgcgccatcagtcaagcctaggcttgaccaccctccgactccggggaccgaggggctggaaggtggggagacgcccgaatctcacctgtgaccgtgagcctggtgcccggcccgaagtactgctcgtgtcgactcaagcctaggcttgatcatgctggcacagagatagagggccgagtcccccagcaacaaggcgttcacattcagctcagagctatagttagggaactggtgacctgagaatcgatcagggaagttgcctctctgtctctcttcctcctcataatactgaaagataaactggggcccctgacccagggcctgttggtaccaggacacagtgtcatgcccagacttaggagagcatctcagagtcacttgctgtcctctcgttttgatcaggtgtgtgggactttgggtgactccagcgtccactaagcctgtgggaaaagtcaagcctaggcttgactgagcgggctggcaaggc

SEQ ID NO: 170 - DNA, 495 bp, Artificial Sequence
  Oligonucleotide
gcctccctcgcgccatcagagagtgtcacacacgtctgtggacccacttttccctgtgacggatctgcaaaagaacctgaaaaatgtcttacctacaactgtgagtctggtgccttgtccaaagaaagcttcagtgtcgacagagtgtcacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagagagtgtcacacacgtctgagcgggctggcaaggc

SEQ ID NO: 171 - DNA, 495 bp, Artificial Sequence
  Oligonucleotide
gcctccctcgcgccatcaggttccgaaacacacgtatttcccaggacagagtcctccctcatcgcacccctcctagagacccccagccttacctacaacggttaacctggtccccgaaccgaaggtgtagccatagtcgacgttccgaaacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaaggttccgaaacacacgtctgagcgggctggcaaggc

SEQ ID NO: 172 - DNA, 495 bp, Artificial Sequence
  Oligonucleotide
gcctccctcgcgccatcagcgttacttacacacgtctggattccagcccctttttgcaagttcccagctgtccagccttgacttactcacctacaacagtgagccaacttccctctccaaaatatatggtgtttcgtcgaccgttacttacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagcgttacttacacacgtctgagcgggctggcaaggc

SEQ ID NO: 173 - DNA, 495 bp, Artificial Sequence
  Oligonucleotide
gcctccctcgcgccatcagtaggagacacacacgtctcctggaactccgaccttatgatacactatcccgaaagaagtcttttacatacccaagacagagagctgggttccactgccaaaaaacagtttttcattgtcgactaggagacacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagtaggagacacacacgtctgagcgggctggcaaggc

SEQ ID NO: 174 - DNA, 495 bp, Artificial Sequence
  Oligonucleotide
gcctccctcgcgccatcaggacactctacacacgtagagaactctgccttcaagggacaatggccataccaccctgattctgcaacttacctaggatggagagtcgagtcccatcaccaaaatgctggggctgatgtcgacgacactctacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaaggacactctacacacgtctgagcgggctggcaaggc

SEQ ID NO: 175 - DNA, 495 bp, Artificial Sequence
  Oligonucleotide
gcctccctcgcgccatcagttcggaacacacacgtatcattgcagtcaaacccaggcacccccgagtcaagagtggagcccccatacctgtcacagtgagcctggtcccgttcccaaagtggaggggtgaattatgtcgacttcggaacacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagttcggaacacacacgtctgagcgggctggcaaggc

SEQ ID NO: 176 - DNA, 495 bp, Artificial Sequence
  Oligonucleotide
gcctccctcgcgccatcagaagtaacgacacacgtgggtcgtgcaggctgggctgctcaccctctctcccacctggagcccccttcttacctagcacggtgagccgtgtccctggcccgaagaactgctcattgtgtcgacaagtaacgacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagaagtaacgacacacgtctgagcgggctggcaaggc

SEQ ID NO: 177 - DNA, 495 bp, Artificial Sequence
  Oligonucleotide
gcctccctcgcgccatcaggtctcctaacacacgtcctctgcccatcccgccctctcggagctctccggagccccaaccgcctccttacccagtacggtcagcctagagccttctccaaaaaacagctccccggtgtcgacgtctcctaacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaaggtctcctaacacacgtctgagcgggctggcaaggc

SEQ ID NO: 178 - DNA, 495 bp, Artificial Sequence
  Oligonucleotide
gcctccctcgcgccatcaggtagacacacacacgtgcgtcccggggcgccccctccccagttccggggcttcagcgggagcccccgcttaccgagcactgtcagccgggtgcctgggccaaaatactgcgtatctgtcgacgtagacacacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaaggtagacacacacacgtctgagcgggctggcaaggc

SEQ ID NO: 179 - DNA, 495 bp, Artificial Sequence
  Oligonucleotide
gcctccctcgcgccatcagcactgtacacacacgtcgcacaaaaacccgagcgcagtctcgtccccggtcccccggcggccccagcttacccagcactgagagccgggtcccggcgccgaagtactgaatgttttgtcgaccactgtacacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagcactgtacacacacgtctgagcgggctggcaaggc

SEQ ID NO: 180 - DNA, 495 bp, Artificial Sequence
  Oligonucleotide
gcctccctcgcgccatcaggatgatccacacacgtccccgcaaaaaccagacccaagccgcccgcgcccgcgccccagcagcccgcgctcaccgagcaccaggagccgcgtgcctggcccgaagtactgggtctcgtcgacgatgatccacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaaggatgatccacacacgtctgagcgggctggcaaggc

SEQ ID NO: 181 - DNA, 495 bp, Artificial Sequence
  Oligonucleotide
gcctccctcgcgccatcagcgccaataacacacgtccgccgccttccacctgaatcccgccgcccgggtggtcccgcgaaaactcacccagcacggtcagcctgctgccggccccgaaagtcaggacgttggcccgtcgaccgccaataacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagcgccaataacacacgtctgagcgggctggcaaggc

SEQ ID NO: 182 - DNA, 495 bp, Artificial Sequence
  Oligonucleotide
gcctccctcgcgccatcagtcaagcctacacacgtccaccctccgactccggggaccgaggggctggaaggtggggagacgcccgaatctcacctgtgaccgtgagcctggtgcccggcccgaagtactgctcgtgtcgactcaagcctacacacgttcatgctggcacagagatagagggccgagtcccctagcaacaaggcgttcacattcagctcagagctatagttagggaactggtgacctgagaattgatcagggaagtttcctcttcctctctcttctttctcataatactgaaagataaactggggcccctgacccagggcctgttggtacgaggacacactggtgtgcccagagataggagagcatctcagagtcacgtgctgtcctctcgttttgatcaggtgtgtgggactttgggtgactccagcgtccactgggcctgtgggaaaagtcaagcctacacacgtctgagcgggctggcaaggc

SEQ ID NO: 183 - DNA, 495 bp, Artificial Sequence
  Oligonucleotide
gcctccctcgcgccatcagagagtgtctagacggactgtggacccacttttccctgtgacggatctgcaaaagaacctgaaaaatgtcttacctacaactgtgagtctggtgccttgtccaaagaaagcttcagtgtcgacagagtgtctagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagagagtgtctagacggactgagcgggctggcaaggc

SEQ ID NO: 184 - DNA, 495 bp, Artificial Sequence
  Oligonucleotide
gcctccctcgcgccatcaggttccgaatagacggaatttcccaggacagagtcctccctcatcgcacccctcctagagacccccagccttacctacaacggttaacctggtccccgaaccgaaggtgtagccatagtcgacgttccgaatagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaaggttccgaatagacggactgagcgggctggcaaggc

SEQ ID NO: 185 - DNA, 495 bp, Artificial Sequence
  Oligonucleotide
gcctccctcgcgccatcagcgttactttagacggactggattccagcccctttttgcaagttcccagctgtccagccttgacttactcacctacaacagtgagccaacttccctctccaaaatatatggtgtttcgtcgaccgttactttagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagcgttactttagacggactgagcgggctggcaaggc

SEQ ID NO: 186 - DNA, 495 bp, Artificial Sequence
  Oligonucleotide
gcctccctcgcgccatcagtaggagactagacggactcctggaactccgaccttatgatacactatcccgaaagaagtcttttacatacccaagacagagagctgggttccactgccaaaaaacagtttttcattgtcgactaggagactagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagtaggagactagacggactgagcgggctggcaaggc

SEQ ID NO: 187 - DNA, 495 bp, Artificial Sequence
  Oligonucleotide
gcctccctcgcgccatcaggacactcttagacggaagagaactctgccttcaagggacaatggccataccaccctgattctgcaacttacctaggatggagagtcgagtcccatcaccaaaatgctggggctgatgtcgacgacactcttagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaaggacactcttagacggactgagcgggctggcaaggc

SEQ ID NO: 188 - DNA, 495 bp, Artificial Sequence
  Oligonucleotide
gcctccctcgcgccatcagttcggaactagacggaatcattgcagtcaaacccaggcacccccgagtcaagagtggagcccccatacctgtcacagtgagcctggtcccgttcccaaagtggaggggtgaattatgtcgacttcggaactagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagttcggaactagacggactgagcgggctggcaaggc

SEQ ID NO: 189 - DNA, 495 bp, Artificial Sequence
  Oligonucleotide
gcctccctcgcgccatcagaagtaacgtagacggagggtcgtgcaggctgggctgctcaccctctctcccacctggagcccccttcttacctagcacggtgagccgtgtccctggcccgaagaactgctcattgtgtcgacaagtaacgtagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagaagtaacgtagacggactgagcgggctggcaaggc

SEQ ID NO: 190 - DNA, 495 bp, Artificial Sequence
  Oligonucleotide
gcctccctcgcgccatcaggtctcctatagacggacctctgcccatcccgccctctcggagctctccggagccccaaccgcctccttacccagtacggtcagcctagagccttctccaaaaaacagctccccggtgtcgacgtctcctatagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaaggtctcctatagacggactgagcgggctggcaaggc

SEQ ID NO: 191 - DNA, 495 bp, Artificial Sequence
  Oligonucleotide
gcctccctcgcgccatcaggtagacactagacggagcgtcccggggcgccccctccccagttccggggcttcagcgggagcccccgcttaccgagcactgtcagccgggtgcctgggccaaaatactgcgtatctgtcgacgtagacactagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaaggtagacactagacggactgagcgggctggcaaggc

SEQ ID NO: 192 - DNA, 495 bp, Artificial Sequence
  Oligonucleotide
gcctccctcgcgccatcagcactgtactagacggacgcacaaaaacccgagcgcagtctcgtccccggtcccccggcggccccagcttacccagcactgagagccgggtcccggcgccgaagtactgaatgttttgtcgaccactgtactagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagcactgtactagacggactgagcgggctggcaaggc

SEQ ID NO: 193 - DNA, 495 bp, Artificial Sequence
  Oligonucleotide
gcctccctcgcgccatcaggatgatcctagacggaccccgcaaaaaccagacccaagccgcccgcgcccgcgccccagcagcccgcgctcaccgagcaccaggagccgcgtgcctggcccgaagtactgggtctcgtcgacgatgatcctagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaaggatgatcctagacggactgagcgggctggcaaggc

SEQ ID NO: 194 - DNA, 495 bp, Artificial Sequence
  Oligonucleotide
gcctccctcgcgccatcagcgccaatatagacggaccgccgccttccacctgaatcccgccgcccgggtggtcccgcgaaaactcacccagcacggtcagcctgctgccggccccgaaagtcaggacgttggcccgtcgaccgccaatatagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagcgccaatatagacggactgagcgggctggcaaggc

SEQ ID NO: 195 - DNA, 495 bp, Artificial Sequence
  Oligonucleotide
gcctccctcgcgccatcagtcaagccttagacggaccaccctccgactccggggaccgaggggctggaaggtggggagacgcccgaatctcacctgtgaccgtgagcctggtgcccggcccgaagtactgctcgtgtcgactcaagccttagacggatcatgctggcacagagatacagggccgagtcctccagctccaaggcgttcacattcagctcagagctataattagggaactggcgacctgaaaatctaggagggaagtttcctctgtttctctcttcaccctcgtcataccaaaggaggaactggaggcccagacccagggcctgttggtaccagtacacactggtgtgcccagagataggagagcatctcagagtcgcttgctgtcctctcgttttgatcaggtgtgtgggactttgtgtgactccagcctccactgggcctgcaggaaaagtcaagccttagacggactgagcgggctggcaaggc

SEQ ID NO: 196 - DNA, 495 bp, Artificial Sequence
  Oligonucleotide
gcctccctcgcgccatcagagagtgtccagctcttctgtggacccacttttccctgtgacggatctgcaaaagaacctgaaaaatgtcttacctacaactgtgagtctggtgccttgtccaaagaaagcttcagtgtcgacagagtgtccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagagagtgtccagctcttctgagcgggctggcaaggc

SEQ ID NO: 197 - DNA, 495 bp, Artificial Sequence
  Oligonucleotide
gcctccctcgcgccatcaggttccgaacagctcttatttcccaggacagagtcctccctcatcgcacccctcctagagacccccagccttacctacaacggttaacctggtccccgaaccgaaggtgtagccatagtcgacgttccgaacagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaaggttccgaacagctcttctgagcgggctggcaaggc

SEQ ID NO: 198 - DNA, 495 bp, Artificial Sequence
  Oligonucleotide
gcctccctcgcgccatcagcgttacttcagctcttctggattccagcccctttttgcaagttcccagctgtccagccttgacttactcacctacaacagtgagccaacttccctctccaaaatatatggtgtttcgtcgaccgttacttcagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagcgttacttcagctcttctgagcgggctggcaaggc

SEQ ID NO: 199 - DNA, 495 bp, Artificial Sequence
  Oligonucleotide
gcctccctcgcgccatcagtaggagaccagctcttctcctggaactccgaccttatgatacactatcccgaaagaagtcttttacatacccaagacagagagctgggttccactgccaaaaaacagtttttcattgtcgactaggagaccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagtaggagaccagctcttctgagcgggctggcaaggc

SEQ ID NO: 200 - DNA, 495 bp, Artificial Sequence
  Oligonucleotide
gcctccctcgcgccatcaggacactctcagctcttagagaactctgccttcaagggacaatggccataccaccctgattctgcaacttacctaggatggagagtcgagtcccatcaccaaaatgctggggctgatgtcgacgacactctcagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaaggacactctcagctcttctgagcgggctggcaaggc

SEQ ID NO: 201 - DNA, 495 bp, Artificial Sequence
  Oligonucleotide
gcctccctcgcgccatcagttcggaaccagctcttatcattgcagtcaaacccaggcacccccgagtcaagagtggagcccccatacctgtcacagtgagcctggtcccgttcccaaagtggaggggtgaattatgtcgacttcggaaccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagttcggaaccagctcttctgagcgggctggcaaggc

SEQ ID NO: 202 - DNA, 495 bp, Artificial Sequence
  Oligonucleotide
gcctccctcgcgccatcagaagtaacgcagctcttgggtcgtgcaggctgggctgctcaccctctctcccacctggagcccccttcttacctagcacggtgagccgtgtccctggcccgaagaactgctcattgtgtcgacaagtaacgcagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagaagtaacgcagctcttctgagcgggctggcaaggc

SEQ ID NO: 203 - DNA, 495 bp, Artificial Sequence
  Oligonucleotide
gcctccctcgcgccatcaggtctcctacagctcttcctctgcccatcccgccctctcggagctctccggagccccaaccgcctccttacccagtacggtcagcctagagccttctccaaaaaacagctccccggtgtcgacgtctcctacagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaaggtctcctacagctcttctgagcgggctggcaaggc

SEQ ID NO: 204 - DNA, 495 bp, Artificial Sequence
  Oligonucleotide
gcctccctcgcgccatcaggtagacaccagctcttgcgtcccggggcgccccctccccagttccggggcttcagcgggagcccccgcttaccgagcactgtcagccgggtgcctgggccaaaatactgcgtatctgtcgacgtagacaccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaaggtagacaccagctcttctgagcgggctggcaaggc

SEQ ID NO: 205 - DNA, 495 bp, Artificial Sequence
  Oligonucleotide
gcctccctcgcgccatcagcactgtaccagctcttcgcacaaaaacccgagcgcagtctcgtccccggtcccccggcggccccagcttacccagcactgagagccgggtcccggcgccgaagtactgaatgttttgtcgaccactgtaccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagcactgtaccagctcttctgagcgggctggcaaggc

SEQ ID NO: 206 - DNA, 495 bp, Artificial Sequence
  Oligonucleotide
gcctccctcgcgccatcaggatgatcccagctcttccccgcaaaaaccagacccaagccgcccgcgcccgcgccccagcagcccgcgctcaccgagcaccaggagccgcgtgcctggcccgaagtactgggtctcgtcgacgatgatcccagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaaggatgatcccagctcttctgagcgggctggcaaggc

SEQ ID NO: 207 - DNA, 495 bp, Artificial Sequence
  Oligonucleotide
gcctccctcgcgccatcagcgccaatacagctcttccgccgccttccacctgaatcccgccgcccgggtggtcccgcgaaaactcacccagcacggtcagcctgctgccggccccgaaagtcaggacgttggcccgtcgaccgccaatacagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagcgccaatacagctcttctgagcgggctggcaaggc

SEQ ID NO: 208 - DNA, 495 bp, Artificial Sequence
  Oligonucleotide
gcctccctcgcgccatcagtcaagcctcagctcttccaccctccgactccggggaccgaggggctggaaggtggggagacgcccgaatctcacctgtgaccgtgagcctggtgcccggcccgaagtactgctcgtgtcgactcaagcctcagctctttcactgctggcacagaagtacacagatgtctgggagggagcagccgactccagcctgagcgagaactcccgtttgtttaatctggagacattgtagccattggggacttctcctttgtcagtggtaccctcagaagctgagtaataaatcagcctcagtcccatgcctgggtcttgtcgataccagtacatggagttatggttcatatcctgggcacactgcagtgtcatgctctgtcctgtcttcaggacctggaattttggggtctgagtgacaccagcattcactggacctgcagagaagtcaagcctcagctcttctgagcgggctggcaaggc

SEQ ID NO: 209 - DNA, 495 bp, Artificial Sequence
  Oligonucleotide
gcctccctcgcgccatcagagagtgtcgagcgatactgtggacccacttttccctgtgacggatctgcaaaagaacctgaaaaatgtcttacctacaactgtgagtctggtgccttgtccaaagaaagcttcagtgtcgacagagtgtcgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagagagtgtcgagcgatactgagcgggctggcaaggc

SEQ ID NO: 210 - DNA, 495 bp, Artificial Sequence
  Oligonucleotide
gcctccctcgcgccatcaggttccgaagagcgataatttcccaggacagagtcctccctcatcgcacccctcctagagacccccagccttacctacaacggttaacctggtccccgaaccgaaggtgtagccatagtcgacgttccgaagagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggttccgaagagcgatactgagcgggctggcaaggc

SEQ ID NO: 211 - DNA, 495 bp, Artificial Sequence
  Oligonucleotide
gcctccctcgcgccatcagcgttacttgagcgatactggattccagcccctttttgcaagttcccagctgtccagccttgacttactcacctacaacagtgagccaacttccctctccaaaatatatggtgtttcgtcgaccgttacttgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcgttacttgagcgatactgagcgggctggcaaggc

SEQ ID NO: 212 - DNA, 495 bp, Artificial Sequence
  Oligonucleotide
gcctccctcgcgccatcagtaggagacgagcgatactcctggaactccgaccttatgatacactatcccgaaagaagtcttttacatacccaagacagagagctgggttccactgccaaaaaacagtttttcattgtcgactaggagacgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagtaggagacgagcgatactgagcgggctggcaaggc

SEQ ID NO: 213 - DNA, 495 bp, Artificial Sequence
  Oligonucleotide
gcctccctcgcgccatcaggacactctgagcgataagagaactctgccttcaagggacaatggccataccaccctgattctgcaacttacctaggatggagagtcgagtcccatcaccaaaatgctggggctgatgtcgacgacactctgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggacactctgagcgatactgagcgggctggcaaggc

SEQ ID NO: 214 - DNA, 495 bp, Artificial Sequence
  Oligonucleotide
gcctccctcgcgccatcagttcggaacgagcgataatcattgcagtcaaacccaggcacccccgagtcaagagtggagcccccatacctgtcacagtgagcctggtcccgttcccaaagtggaggggtgaattatgtcgacttcggaacgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagttcggaacgagcgatactgagcgggctggcaaggc

SEQ ID NO: 215 - DNA, 495 bp, Artificial Sequence
  Oligonucleotide
gcctccctcgcgccatcagaagtaacggagcgatagggtcgtgcaggctgggctgctcaccctctctcccacctggagcccccttcttacctagcacggtgagccgtgtccctggcccgaagaactgctcattgtgtcgacaagtaacggagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagaagtaacggagcgatactgagcgggctggcaaggc

SEQ ID NO: 216 - DNA, 495 bp, Artificial Sequence
  Oligonucleotide
gcctccctcgcgccatcaggtctcctagagcgatacctctgcccatcccgccctctcggagctctccggagccccaaccgcctccttacccagtacggtcagcctagagccttctccaaaaaacagctccccggtgtcgacgtctcctagagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggtctcctagagcgatactgagcgggctggcaaggc

SEQ ID NO: 217 - DNA, 495 bp, Artificial Sequence
  Oligonucleotide
gcctccctcgcgccatcaggtagacacgagcgatagcgtcccggggcgccccctccccagttccggggcttcagcgggagcccccgcttaccgagcactgtcagccgggtgcctgggccaaaatactgcgtatctgtcgacgtagacacgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggtagacacgagcgatactgagcgggctggcaaggc

SEQ ID NO: 218 - DNA, 495 bp, Artificial Sequence
  Oligonucleotide
gcctccctcgcgccatcagcactgtacgagcgatacgcacaaaaacccgagcgcagtctcgtccccggtcccccggcggccccagcttacccagcactgagagccgggtcccggcgccgaagtactgaatgttttgtcgaccactgtacgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcactgtacgagcgatactgagcgggctggcaaggc

SEQ ID NO: 219 - DNA, 495 bp, Artificial Sequence
  Oligonucleotide
gcctccctcgcgccatcaggatgatccgagcgataccccgcaaaaaccagacccaagccgcccgcgcccgcgccccagcagcccgcgctcaccgagcaccaggagccgcgtgcctggcccgaagtactgggtctcgtcgacgatgatccgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggatgatccgagcgatactgagcgggctggcaaggc

SEQ ID NO: 220 - DNA, 495 bp, Artificial Sequence
  Oligonucleotide
gcctccctcgcgccatcagcgccaatagagcgataccgccgccttccacctgaatcccgccgcccgggtggtcccgcgaaaactcacccagcacggtcagcctgctgccggccccgaaagtcaggacgttggcccgtcgaccgccaatagagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcgccaatagagcgatactgagcgggctggcaaggc

SEQ ID NO: 221 - DNA, 495 bp, Artificial Sequence
  Oligonucleotide
gcctccctcgcgccatcagtcaagcctgagcgataccaccctccgactccggggaccgaggggctggaaggtggggagacgcccgaatctcacctgtgaccgtgagcctggtgcccggcccgaagtactgctcgtgtcgactcaagcctgagcgatatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagtcaagcctgagcgatactgagcgggctggcaaggc

SEQ ID NO: 222 - DNA, 495 bp, Artificial Sequence
  Oligonucleotide
gcctccctcgcgccatcagagagtgtcgcatctgactgtggacccacttttccctgtgacggatctgcaaaagaacctgaaaaatgtcttacctacaactgtgagtctggtgccttgtccaaagaaagcttcagtgtcgacagagtgtcgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagagagtgtcgcatctgactgagcgggctggcaaggc

SEQ ID NO: 223 - DNA, 495 bp, Artificial Sequence
  Oligonucleotide
gcctccctcgcgccatcaggttccgaagcatctgaatttcccaggacagagtcctccctcatcgcacccctcctagagacccccagccttacctacaacggttaacctggtccccgaaccgaaggtgtagccatagtcgacgttccgaagcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggttccgaagcatctgactgagcgggctggcaaggc

SEQ ID NO: 224 - DNA, 495 bp, Artificial Sequence
  Oligonucleotide
gcctccctcgcgccatcagcgttacttgcatctgactggattccagcccctttttgcaagttcccagctgtccagccttgacttactcacctacaacagtgagccaacttccctctccaaaatatatggtgtttcgtcgaccgttacttgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcgttacttgcatctgactgagcgggctggcaaggc

SEQ ID NO: 225 - DNA, 495 bp, Artificial Sequence
  Oligonucleotide
gcctccctcgcgccatcagtaggagacgcatctgactcctggaactccgaccttatgatacactatcccgaaagaagtcttttacatacccaagacagagagctgggttccactgccaaaaaacagtttttcattgtcgactaggagacgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagtaggagacgcatctgactgagcgggctggcaaggc

SEQ ID NO: 226 - DNA, 495 bp, Artificial Sequence
  Oligonucleotide
gcctccctcgcgccatcaggacactctgcatctgaagagaactctgccttcaagggacaatggccataccaccctgattctgcaacttacctaggatggagagtcgagtcccatcaccaaaatgctggggctgatgtcgacgacactctgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggacactctgcatctgactgagcgggctggcaaggc

SEQ ID NO: 227 - DNA, 495 bp, Artificial Sequence
  Oligonucleotide
gcctccctcgcgccatcagttcggaacgcatctgaatcattgcagtcaaacccaggcacccccgagtcaagagtggagcccccatacctgtcacagtgagcctggtcccgttcccaaagtggaggggtgaattatgtcgacttcggaacgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagttcggaacgcatctgactgagcgggctggcaaggc

SEQ ID NO: 228 - DNA, 495 bp, Artificial Sequence
  Oligonucleotide
gcctccctcgcgccatcagaagtaacggcatctgagggtcgtgcaggctgggctgctcaccctctctcccacctggagcccccttcttacctagcacggtgagccgtgtccctggcccgaagaactgctcattgtgtcgacaagtaacggcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagaagtaacggcatctgactgagcgggctggcaaggc

SEQ ID NO: 229 - DNA, 495 bp, Artificial Sequence
  Oligonucleotide
gcctccctcgcgccatcaggtctcctagcatctgacctctgcccatcccgccctctcggagctctccggagccccaaccgcctccttacccagtacggtcagcctagagccttctccaaaaaacagctccccggtgtcgacgtctcctagcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggtctcctagcatctgactgagcgggctggcaaggc

SEQ ID NO: 230 - DNA, 495 bp, Artificial Sequence
  Oligonucleotide
gcctccctcgcgccatcaggtagacacgcatctgagcgtcccggggcgccccctccccagttccggggcttcagcgggagcccccgcttaccgagcactgtcagccgggtgcctgggccaaaatactgcgtatctgtcgacgtagacacgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggtagacacgcatctgactgagcgggctggcaaggc

SEQ ID NO: 231 - DNA, 495 bp, Artificial Sequence
  Oligonucleotide
gcctccctcgcgccatcagcactgtacgcatctgacgcacaaaaacccgagcgcagtctcgtccccggtcccccggcggccccagcttacccagcactgagagccgggtcccggcgccgaagtactgaatgttttgtcgaccactgtacgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcactgtacgcatctgactgagcgggctggcaaggc

SEQ ID NO: 232 - DNA, 495 bp, Artificial Sequence
  Oligonucleotide
gcctccctcgcgccatcaggatgatccgcatctgaccccgcaaaaaccagacccaagccgcccgcgcccgcgccccagcagcccgcgctcaccgagcaccaggagccgcgtgcctggcccgaagtactgggtctcgtcgacgatgatccgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaaggatgatccgcatctgactgagcgggctggcaaggc

SEQ ID NO: 233 - DNA, 495 bp, Artificial Sequence
  Oligonucleotide
gcctccctcgcgccatcagcgccaatagcatctgaccgccgccttccacctgaatcccgccgcccgggtggtcccgcgaaaactcacccagcacggtcagcctgctgccggccccgaaagtcaggacgttggcccgtcgaccgccaatagcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagcgccaatagcatctgactgagcgggctggcaaggc

SEQ ID NO: 234 - DNA, 495 bp, Artificial Sequence
  Oligonucleotide
gcctccctcgcgccatcagtcaagcctgcatctgaccaccctccgactccggggaccgaggggctggaaggtggggagacgcccgaatctcacctgtgaccgtgagcctggtgcccggcccgaagtactgctcgtgtcgactcaagcctgcatctgatcactgctggcacagaagtacacagatgtttgggagggagcagccgactccaaccccagcaggaaattctgtttttttaatctggagacattgtagccatcagggacctctcctttggcagttgtaccctcaccaactgagtaatgaatcagcctcagccccatgcctgggtcttgtcgataccagtacatgtattcatggttcatatcctgggcacacagcagtgtcatgctctgtcctgtcttcaggacccggaattttggggtctgagtgacaccagcattcactggacctgcagagaagtcaagcctgcatctgactgagcgggctggcaaggc

SEQ ID NO: 235 - DNA, 495 bp, Artificial Sequence
  Oligonucleotide
gcctccctcgcgccatcagagagtgtctgctacacctgtggacccacttttccctgtgacggatctgcaaaagaacctgaaaaatgtcttacctacaactgtgagtctggtgccttgtccaaagaaagcttcagtgtcgacagagtgtctgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagagagtgtctgctacacctgagcgggctggcaaggc

SEQ ID NO: 236 - DNA, 495 bp, Artificial Sequence
  Oligonucleotide
gcctccctcgcgccatcaggttccgaatgctacacatttcccaggacagagtcctccctcatcgcacccctcctagagacccccagccttacctacaacggttaacctggtccccgaaccgaaggtgtagccatagtcgacgttccgaatgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaaggttccgaatgctacacctgagcgggctggcaaggc

SEQ ID NO: 237 - DNA, 495 bp, Artificial Sequence
  Oligonucleotide
gcctccctcgcgccatcagcgttactttgctacacctggattccagcccctttttgcaagttcccagctgtccagccttgacttactcacctacaacagtgagccaacttccctctccaaaatatatggtgtttcgtcgaccgttactttgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagcgttactttgctacacctgagcgggctggcaaggc

SEQ ID NO: 238 - DNA, 495 bp, Artificial Sequence
  Oligonucleotide
gcctccctcgcgccatcagtaggagactgctacacctcctggaactccgaccttatgatacactatcccgaaagaagtcttttacatacccaagacagagagctgggttccactgccaaaaaacagtttttcattgtcgactaggagactgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagtaggagactgctacacctgagcgggctggcaaggc

SEQ ID NO: 239 - DNA, 495 bp, Artificial Sequence
  Oligonucleotide
gcctccctcgcgccatcaggacactcttgctacacagagaactctgccttcaagggacaatggccataccaccctgattctgcaacttacctaggatggagagtcgagtcccatcaccaaaatgctggggctgatgtcgacgacactcttgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaaggacactcttgctacacctgagcgggctggcaaggc

SEQ ID NO: 240 - DNA, 495 bp, Artificial Sequence
  Oligonucleotide
gcctccctcgcgccatcagttcggaactgctacacatcattgcagtcaaacccaggcacccccgagtcaagagtggagcccccatacctgtcacagtgagcctggtcccgttcccaaagtggaggggtgaattatgtcgacttcggaactgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagttcggaactgctacacctgagcgggctggcaaggc

SEQ ID NO: 241 - DNA, 495 bp, Artificial Sequence
  Oligonucleotide
gcctccctcgcgccatcagaagtaacgtgctacacgggtcgtgcaggctgggctgctcaccctctctcccacctggagcccccttcttacctagcacggtgagccgtgtccctggcccgaagaactgctcattgtgtcgacaagtaacgtgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagaagtaacgtgctacacctgagcgggctggcaaggc

SEQ ID NO: 242 - DNA, 495 bp, Artificial Sequence
  Oligonucleotide
gcctccctcgcgccatcaggtctcctatgctacaccctctgcccatcccgccctctcggagctctccggagccccaaccgcctccttacccagtacggtcagcctagagccttctccaaaaaacagctccccggtgtcgacgtctcctatgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaaggtctcctatgctacacctgagcgggctggcaaggc

SEQ ID NO: 243 - DNA, 495 bp, Artificial Sequence
  Oligonucleotide
gcctccctcgcgccatcaggtagacactgctacacgcgtcccggggcgccccctccccagttccggggcttcagcgggagcccccgcttaccgagcactgtcagccgggtgcctgggccaaaatactgcgtatctgtcgacgtagacactgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaaggtagacactgctacacctgagcgggctggcaaggc

SEQ ID NO: 244 - DNA, 495 bp, Artificial Sequence
  Oligonucleotide
gcctccctcgcgccatcagcactgtactgctacaccgcacaaaaacccgagcgcagtctcgtccccggtcccccggcggccccagcttacccagcactgagagccgggtcccggcgccgaagtactgaatgttttgtcgaccactgtactgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagcactgtactgctacacctgagcgggctggcaaggc

SEQ ID NO: 245 - DNA, 495 bp, Artificial Sequence
  Oligonucleotide
gcctccctcgcgccatcaggatgatcctgctacacccccgcaaaaaccagacccaagccgcccgcgcccgcgccccagcagcccgcgctcaccgagcaccaggagccgcgtgcctggcccgaagtactgggtctcgtcgacgatgatcctgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaaggatgatcctgctacacctgagcgggctggcaaggc

SEQ ID NO: 246 - DNA, 495 bp, Artificial Sequence
  Oligonucleotide
gcctccctcgcgccatcagcgccaatatgctacacccgccgccttccacctgaatcccgccgcccgggtggtcccgcgaaaactcacccagcacggtcagcctgctgccggccccgaaagtcaggacgttggcccgtcgaccgccaatatgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagcgccaatatgctacacctgagcgggctggcaaggc

SEQ ID NO: 247 - DNA, 495 bp, Artificial Sequence
  Oligonucleotide
gcctccctcgcgccatcagtcaagccttgctacacccaccctccgactccggggaccgaggggctggaaggtggggagacgcccgaatctcacctgtgaccgtgagcctggtgcccggcccgaagtactgctcgtgtcgactcaagccttgctacactcactgctggcacagaagtacacagatgtctgagagggtacagcagacgccaacgtgagggggaaatcatctgtgtttgctctggagacactataaccatcagggacttctcctttgccagtggtacctgcagtatttgaataatggatgagccttagccccagtcctagatcttgtctataccagtacatggcattatgtctcatatcctgggtacatctcagtgtcatgcgccgtcctgctgccaggatctgagatgttggtgcctgggtgatcccagcaatcactggacctacagagaagtcaagccttgctacacctgagcgggctggcaaggc

SEQ ID NO: 248 - DNA, 495 bp, Artificial Sequence
  Oligonucleotide
gcctccctcgcgccatcagagagtgtcaactgccactgtggacccacttttccctgtgacggatctgcaaaagaacctgaaaaatgtcttacctacaactgtgagtctggtgccttgtccaaagaaagcttcagtgtcgacagagtgtcaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagagagtgtcaactgccactgagcgggctggcaaggc

SEQ ID NO: 249 - DNA, 495 bp, Artificial Sequence
  Oligonucleotide
gcctccctcgcgccatcaggttccgaaaactgccaatttcccaggacagagtcctccctcatcgcacccctcctagagacccccagccttacctacaacggttaacctggtccccgaaccgaaggtgtagccatagtcgacgttccgaaaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaaggttccgaaaactgccactgagcgggctggcaaggc

SEQ ID NO: 250 - DNA, 495 bp, Artificial Sequence
  Oligonucleotide
gcctccctcgcgccatcagcgttacttaactgccactggattccagcccctttttgcaagttcccagctgtccagccttgacttactcacctacaacagtgagccaacttccctctccaaaatatatggtgtttcgtcgaccgttacttaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagcgttacttaactgccactgagcgggctggcaaggc

SEQ ID NO: 251 - DNA, 495 bp, Artificial Sequence
  Oligonucleotide
gcctccctcgcgccatcagtaggagacaactgccactcctggaactccgaccttatgatacactatcccgaaagaagtcttttacatacccaagacagagagctgggttccactgccaaaaaacagtttttcattgtcgactaggagacaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagtaggagacaactgccactgagcgggctggcaaggc

SEQ ID NO: 252 - DNA, 495 bp, Artificial Sequence
  Oligonucleotide
gcctccctcgcgccatcaggacactctaactgccaagagaactctgccttcaagggacaatggccataccaccctgattctgcaacttacctaggatggagagtcgagtcccatcaccaaaatgctggggctgatgtcgacgacactctaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaaggacactctaactgccactgagcgggctggcaaggc

SEQ ID NO: 253 - DNA, 495 bp, Artificial Sequence
  Oligonucleotide
gcctccctcgcgccatcagttcggaacaactgccaatcattgcagtcaaacccaggcacccccgagtcaagagtggagcccccatacctgtcacagtgagcctggtcccgttcccaaagtggaggggtgaattatgtcgacttcggaacaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagttcggaacaactgccactgagcgggctggcaaggc

SEQ ID NO: 254 - DNA, 495 bp, Artificial Sequence
  Oligonucleotide
gcctccctcgcgccatcagaagtaacgaactgccagggtcgtgcaggctgggctgctcaccctctctcccacctggagcccccttcttacctagcacggtgagccgtgtccctggcccgaagaactgctcattgtgtcgacaagtaacgaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagaagtaacgaactgccactgagcgggctggcaaggc

SEQ ID NO: 255 - DNA, 495 bp, Artificial Sequence
  Oligonucleotide
gcctccctcgcgccatcaggtctcctaaactgccacctctgcccatcccgccctctcggagctctccggagccccaaccgcctccttacccagtacggtcagcctagagccttctccaaaaaacagctccccggtgtcgacgtctcctaaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaaggtctcctaaactgccactgagcgggctggcaaggc

SEQ ID NO: 256 - DNA, 495 bp, Artificial Sequence
  Oligonucleotide
gcctccctcgcgccatcaggtagacacaactgccagcgtcccggggcgccccctccccagttccggggcttcagcgggagcccccgcttaccgagcactgtcagccgggtgcctgggccaaaatactgcgtatctgtcgacgtagacacaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaaggtagacacaactgccactgagcgggctggcaaggc

SEQ ID NO: 257 - DNA, 495 bp, Artificial Sequence
  Oligonucleotide
gcctccctcgcgccatcagcactgtacaactgccacgcacaaaaacccgagcgcagtctcgtccccggtcccccggcggccccagcttacccagcactgagagccgggtcccggcgccgaagtactgaatgttttgtcgaccactgtacaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagcactgtacaactgccactgagcgggctggcaaggc

SEQ ID NO: 258 - DNA, 495 bp, Artificial Sequence
  Oligonucleotide
gcctccctcgcgccatcaggatgatccaactgccaccccgcaaaaaccagacccaagccgcccgcgcccgcgccccagcagcccgcgctcaccgagcaccaggagccgcgtgcctggcccgaagtactgggtctcgtcgacgatgatccaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaaggatgatccaactgccactgagcgggctggcaaggc

SEQ ID NO: 259 - DNA, 495 bp, Artificial Sequence
  Oligonucleotide
gcctccctcgcgccatcagcgccaataaactgccaccgccgccttccacctgaatcccgccgcccgggtggtcccgcgaaaactcacccagcacggtcagcctgctgccggccccgaaagtcaggacgttggcccgtcgaccgccaataaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagcgccaataaactgccactgagcgggctggcaaggc

SEQ ID NO: 260 - DNA, 495 bp, Artificial Sequence
  Oligonucleotide
gcctccctcgcgccatcagtcaagcctaactgccaccaccctccgactccggggaccgaggggctggaaggtggggagacgcccgaatctcacctgtgaccgtgagcctggtgcccggcccgaagtactgctcgtgtcgactcaagcctaactgccatcactgctggcacagaagtacacagatgtctgggagggagcagccgacagcagcctgagcgggaaatcctctgtggttgatctggagacattgtagccattggggacttctccttggtcagtgataccagcaccaactgagtaatgaatcagcctcagccccatgcctgggtcttgtcgataccaggacatgtattcatggttcatatcctgggcacactgcagtgtcatgctctgtcctgtcttcaggacctggaattttggggtctgagtgacaccagcattcactggacctgcagagaagtcaagcctaactgccactgagcgggctggcaaggc

SEQ ID NO: 261 - DNA, 495 bp, Artificial Sequence
  Oligonucleotide
gcctccctcgcgccatcagagagtgtcttggactgctgtggacccacttttccctgtgacggatctgcaaaagaacctgaaaaatgtcttacctacaactgtgagtctggtgccttgtccaaagaaagcttcagtgtcgacagagtgtcttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagagagtgtcttggactgctgagcgggctggcaaggc

SEQ ID NO: 262 - DNA, 495 bp, Artificial Sequence
  Oligonucleotide
gcctccctcgcgccatcaggttccgaattggactgatttcccaggacagagtcctccctcatcgcacccctcctagagacccccagccttacctacaacggttaacctggtccccgaaccgaaggtgtagccatagtcgacgttccgaattggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaaggttccgaattggactgctgagcgggctggcaaggc

SEQ ID NO: 263 - DNA, 495 bp, Artificial Sequence
  Oligonucleotide
gcctccctcgcgccatcagcgttacttttggactgctggattccagcccctttttgcaagttcccagctgtccagccttgacttactcacctacaacagtgagccaacttccctctccaaaatatatggtgtttcgtcgaccgttacttttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagcgttacttttggactgctgagcgggctggcaaggc

SEQ ID NO: 264 - DNA, 495 bp, Artificial Sequence
  Oligonucleotide
gcctccctcgcgccatcagtaggagacttggactgctcctggaactccgaccttatgatacactatcccgaaagaagtcttttacatacccaagacagagagctgggttccactgccaaaaaacagtttttcattgtcgactaggagacttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagtaggagacttggactgctgagcgggctggcaaggc

SEQ ID NO: 265 - DNA, 495 bp, Artificial Sequence
  Oligonucleotide
gcctccctcgcgccatcaggacactctttggactgagagaactctgccttcaagggacaatggccataccaccctgattctgcaacttacctaggatggagagtcgagtcccatcaccaaaatgctggggctgatgtcgacgacactctttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaaggacactctttggactgctgagcgggctggcaaggc

SEQ ID NO: 266 - DNA, 495 bp, Artificial Sequence
  Oligonucleotide
gcctccctcgcgccatcagttcggaacttggactgatcattgcagtcaaacccaggcacccccgagtcaagagtggagcccccatacctgtcacagtgagcctggtcccgttcccaaagtggaggggtgaattatgtcgacttcggaacttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagttcggaacttggactgctgagcgggctggcaaggc

SEQ ID NO: 267 - DNA, 495 bp, Artificial Sequence
  Oligonucleotide
gcctccctcgcgccatcagaagtaacgttggactggggtcgtgcaggctgggctgctcaccctctctcccacctggagcccccttcttacctagcacggtgagccgtgtccctggcccgaagaactgctcattgtgtcgacaagtaacgttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagaagtaacgttggactgctgagcgggctggcaaggc

SEQ ID NO: 268 - DNA, 495 bp, Artificial Sequence
  Oligonucleotide
gcctccctcgcgccatcaggtctcctattggactgcctctgcccatcccgccctctcggagctctccggagccccaaccgcctccttacccagtacggtcagcctagagccttctccaaaaaacagctccccggtgtcgacgtctcctattggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaaggtctcctattggactgctgagcgggctggcaaggc

SEQ ID NO: 269 - DNA, 495 bp, Artificial Sequence
  Oligonucleotide
gcctccctcgcgccatcaggtagacacttggactggcgtcccggggcgccccctccccagttccggggcttcagcgggagcccccgcttaccgagcactgtcagccgggtgcctgggccaaaatactgcgtatctgtcgacgtagacacttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaaggtagacacttggactgctgagcgggctggcaaggc

SEQ ID NO: 270 - DNA, 495 bp, Artificial Sequence
  Oligonucleotide
gcctccctcgcgccatcagcactgtacttggactgcgcacaaaaacccgagcgcagtctcgtccccggtcccccggcggccccagcttacccagcactgagagccgggtcccggcgccgaagtactgaatgttttgtcgaccactgtacttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagcactgtacttggactgctgagcgggctggcaaggc

SEQ ID NO: 271 - DNA, 495 bp, Artificial Sequence
  Oligonucleotide
gcctccctcgcgccatcaggatgatccttggactgccccgcaaaaaccagacccaagccgcccgcgcccgcgccccagcagcccgcgctcaccgagcaccaggagccgcgtgcctggcccgaagtactgggtctcgtcgacgatgatccttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaaggatgatccttggactgctgagcgggctggcaaggc

SEQ ID NO: 272 - DNA, 495 bp, Artificial Sequence
  Oligonucleotide
gcctccctcgcgccatcagcgccaatattggactgccgccgccttccacctgaatcccgccgcccgggtggtcccgcgaaaactcacccagcacggtcagcctgctgccggccccgaaagtcaggacgttggcccgtcgaccgccaatattggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagcgccaatattggactgctgagcgggctggcaaggc

SEQ ID NO: 273 - DNA, 495 bp, Artificial Sequence
  Oligonucleotide
gcctccctcgcgccatcagtcaagcctttggactgccaccctccgactccggggaccgaggggctggaaggtggggagacgcccgaatctcacctgtgaccgtgagcctggtgcccggcccgaagtactgctcgtgtcgactcaagcctttggactgtcactgctggcacagaagtacacagatgtctgggagggagcagccaactccagcctgagcgggaaatcctctgtggttgatctggagacgttgtagccattcgggacttctcctttatcagtgataccagcaccaactgaataataaatcagcttcagccccatgcctgggtcttgtcgataccagtacatgtagttatggttcatatcctgggtacactgcagtgtcatgctctgtcctatcttcaggatgcggaattttggggtctgagtgacaccagcattcactggacctgcagagaagtcaagcctttggactgctgagcgggctggcaaggc

SEQ ID NO: 274 - DNA, 495 bp, Artificial Sequence
  Oligonucleotide
gcctccctcgcgccatcagagagtgtccgtacgtactgtggacccacttttccctgtgacggatctgcaaaagaacctgaaaaatgtcttacctacaactgtgagtctggtgccttgtccaaagaaagcttcagtgtcgacagagtgtccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagagagtgtccgtacgtactgagcgggctggcaaggc

SEQ ID NO: 275 - DNA, 495 bp, Artificial Sequence
  Oligonucleotide
gcctccctcgcgccatcaggttccgaacgtacgtaatttcccaggacagagtcctccctcatcgcacccctcctagagacccccagccttacctacaacggttaacctggtccccgaaccgaaggtgtagccatagtcgacgttccgaacgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaaggttccgaacgtacgtactgagcgggctggcaaggc

SEQ ID NO: 276 - DNA, 495 bp, Artificial Sequence
  Oligonucleotide
gcctccctcgcgccatcagcgttacttcgtacgtactggattccagcccctttttgcaagttcccagctgtccagccttgacttactcacctacaacagtgagccaacttccctctccaaaatatatggtgtttcgtcgaccgttacttcgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagcgttacttcgtacgtactgagcgggctggcaaggc

SEQ ID NO: 277 - DNA, 495 bp, Artificial Sequence
  Oligonucleotide
gcctccctcgcgccatcagtaggagaccgtacgtactcctggaactccgaccttatgatacactatcccgaaagaagtcttttacatacccaagacagagagctgggttccactgccaaaaaacagtttttcattgtcgactaggagaccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagtaggagaccgtacgtactgagcgggctggcaaggc

SEQ ID NO: 278 - DNA, 495 bp, Artificial Sequence
  Oligonucleotide
gcctccctcgcgccatcaggacactctcgtacgtaagagaactctgccttcaagggacaatggccataccaccctgattctgcaacttacctaggatggagagtcgagtcccatcaccaaaatgctggggctgatgtcgacgacactctcgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaaggacactctcgtacgtactgagcgggctggcaaggc

SEQ ID NO: 279 - DNA, 495 bp, Artificial Sequence
  Oligonucleotide
gcctccctcgcgccatcagttcggaaccgtacgtaatcattgcagtcaaacccaggcacccccgagtcaagagtggagcccccatacctgtcacagtgagcctggtcccgttcccaaagtggaggggtgaattatgtcgacttcggaaccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagttcggaaccgtacgtactgagcgggctggcaaggc

SEQ ID NO: 280 - DNA, 495 bp, Artificial Sequence
  Oligonucleotide
gcctccctcgcgccatcagaagtaacgcgtacgtagggtcgtgcaggctgggctgctcaccctctctcccacctggagcccccttcttacctagcacggtgagccgtgtccctggcccgaagaactgctcattgtgtcgacaagtaacgcgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagaagtaacgcgtacgtactgagcgggctggcaaggc

SEQ ID NO: 281 - DNA, 495 bp, Artificial Sequence
  Oligonucleotide
gcctccctcgcgccatcaggtctcctacgtacgtacctctgcccatcccgccctctcggagctctccggagccccaaccgcctccttacccagtacggtcagcctagagccttctccaaaaaacagctccccggtgtcgacgtctcctacgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaaggtctcctacgtacgtactgagcgggctggcaaggc

SEQ ID NO: 282 - DNA, 495 bp, Artificial Sequence
  Oligonucleotide
gcctccctcgcgccatcaggtagacaccgtacgtagcgtcccggggcgccccctccccagttccggggcttcagcgggagcccccgcttaccgagcactgtcagccgggtgcctgggccaaaatactgcgtatctgtcgacgtagacaccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaaggtagacaccgtacgtactgagcgggctggcaaggc

SEQ ID NO: 283 - DNA, 495 bp, Artificial Sequence
  Oligonucleotide
gcctccctcgcgccatcagcactgtaccgtacgtacgcacaaaaacccgagcgcagtctcgtccccggtcccccggcggccccagcttacccagcactgagagccgggtcccggcgccgaagtactgaatgttttgtcgaccactgtaccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagcactgtaccgtacgtactgagcgggctggcaaggc

SEQ ID NO: 284 - DNA, 495 bp, Artificial Sequence
  Oligonucleotide
gcctccctcgcgccatcaggatgatcccgtacgtaccccgcaaaaaccagacccaagccgcccgcgcccgcgccccagcagcccgcgctcaccgagcaccaggagccgcgtgcctggcccgaagtactgggtctcgtcgacgatgatcccgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaaggatgatcccgtacgtactgagcgggctggcaaggc

SEQ ID NO: 285 - DNA, 495 bp, Artificial Sequence
  Oligonucleotide
gcctccctcgcgccatcagcgccaatacgtacgtaccgccgccttccacctgaatcccgccgcccgggtggtcccgcgaaaactcacccagcacggtcagcctgctgccggccccgaaagtcaggacgttggcccgtcgaccgccaatacgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagcgccaatacgtacgtactgagcgggctggcaaggc

SEQ ID NO: 286 - DNA, 495 bp, Artificial Sequence
  Oligonucleotide
gcctccctcgcgccatcagtcaagcctcgtacgtaccaccctccgactccggggaccgaggggctggaaggtggggagacgcccgaatctcacctgtgaccgtgagcctggtgcccggcccgaagtactgctcgtgtcgactcaagcctcgtacgtatcactgctggcacagaagtaaacagaagtctgagagggagcagctgactccagcttgagggggaaatcctctgtgtttgatctggagacattgtagccattgggaacttctcctttgtcagtgagagcagcagcaactgagtagtaaatcagcctcagccccttgcctgggtcttgtcgataccgatacatgtattcatggttcatatcctgggcacacagcagagtcatgctctgtcctgtcttcaggacgtggaattttggggtctgagtgacaccagcattcattggacctgcagggaagtcaagcctcgtacgtactgagcgggctggcaaggc

SEQ ID NO: 287 - DNA, 495 bp, Artificial Sequence
  Oligonucleotide
gcctccctcgcgccatcagagagtgtctcggtactctgtggacccacttttccctgtgacggatctgcaaaagaacctgaaaaatgtcttacctacaactgtgagtctggtgccttgtccaaagaaagcttcagtgtcgacagagtgtctcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacagagtgtctcggtactctgagcgggctggcaaggc

SEQ ID NO: 288 - DNA, 495 bp, Artificial Sequence
  Oligonucleotide
gcctccctcgcgccatcaggttccgaatcggtactatttcccaggacagagtcctccctcatcgcacccctcctagagacccccagccttacctacaacggttaacctggtccccgaaccgaaggtgtagccatagtcgacgttccgaatcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacgttccgaatcggtactctgagcgggctggcaaggc

SEQ ID NO: 289 - DNA, 495 bp, Artificial Sequence
  Oligonucleotide
gcctccctcgcgccatcagcgttactttcggtactctggattccagcccctttttgcaagttcccagctgtccagccttgacttactcacctacaacagtgagccaacttccctctccaaaatatatggtgtttcgtcgaccgttactttcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaaccgttactttcggtactctgagcgggctggcaaggc

SEQ ID NO: 290 - DNA, 495 bp, Artificial Sequence
  Oligonucleotide
gcctccctcgcgccatcagtaggagactcggtactctcctggaactccgaccttatgatacactatcccgaaagaagtcttttacatacccaagacagagagctgggttccactgccaaaaaacagtttttcattgtcgactaggagactcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaactaggagactcggtactctgagcgggctggcaaggc

SEQ ID NO: 291 - DNA, 495 bp, Artificial Sequence
  Oligonucleotide
gcctccctcgcgccatcaggacactcttcggtactagagaactctgccttcaagggacaatggccataccaccctgattctgcaacttacctaggatggagagtcgagtcccatcaccaaaatgctggggctgatgtcgacgacactcttcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacgacactcttcggtactctgagcgggctggcaaggc

SEQ ID NO: 292 - DNA, 495 bp, Artificial Sequence
  Oligonucleotide
gcctccctcgcgccatcagttcggaactcggtactatcattgcagtcaaacccaggcacccccgagtcaagagtggagcccccatacctgtcacagtgagcctggtcccgttcccaaagtggaggggtgaattatgtcgacttcggaactcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacttcggaactcggtactctgagcgggctggcaaggc

SEQ ID NO: 293 - DNA, 495 bp, Artificial Sequence
  Oligonucleotide
gcctccctcgcgccatcagaagtaacgtcggtactgggtcgtgcaggctgggctgctcaccctctctcccacctggagcccccttcttacctagcacggtgagccgtgtccctggcccgaagaactgctcattgtgtcgacaagtaacgtcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacaagtaacgtcggtactctgagcgggctggcaaggc

SEQ ID NO: 294 - DNA, 495 bp, Artificial Sequence
  Oligonucleotide
gcctccctcgcgccatcaggtctcctatcggtactcctctgcccatcccgccctctcggagctctccggagccccaaccgcctccttacccagtacggtcagcctagagccttctccaaaaaacagctccccggtgtcgacgtctcctatcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacgtctcctatcggtactctgagcgggctggcaaggc

SEQ ID NO: 295 - DNA, 495 bp, Artificial Sequence
  Oligonucleotide
gcctccctcgcgccatcaggtagacactcggtactgcgtcccggggcgccccctccccagttccggggcttcagcgggagcccccgcttaccgagcactgtcagccgggtgcctgggccaaaatactgcgtatctgtcgacgtagacactcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacgtagacactcggtactctgagcgggctggcaaggc

SEQ ID NO: 296 - DNA, 495 bp, Artificial Sequence
  Oligonucleotide
gcctccctcgcgccatcagcactgtactcggtactcgcacaaaaacccgagcgcagtctcgtccccggtcccccggcggccccagcttacccagcactgagagccgggtcccggcgccgaagtactgaatgttttgtcgaccactgtactcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaaccactgtactcggtactctgagcgggctggcaaggc

SEQ ID NO: 297 - DNA, 495 bp, Artificial Sequence
  Oligonucleotide
gcctccctcgcgccatcaggatgatcctcggtactccccgcaaaaaccagacccaagccgcccgcgcccgcgccccagcagcccgcgctcaccgagcaccaggagccgcgtgcctggcccgaagtactgggtctcgtcgacgatgatcctcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaacgatgatcctcggtactctgagcgggctggcaaggc

SEQ ID NO: 298 - DNA, 495 bp, Artificial Sequence
  Oligonucleotide
gcctccctcgcgccatcagcgccaatatcggtactccgccgccttccacctgaatcccgccgcccgggtggtcccgcgaaaactcacccagcacggtcagcctgctgccggccccgaaagtcaggacgttggcccgtcgaccgccaatatcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaaccgccaatatcggtactctgagcgggctggcaaggc

SEQ ID NO: 299 - DNA, 495 bp, Artificial Sequence
  Oligonucleotide
gcctccctcgcgccatcagtcaagccttcggtactccaccctccgactccggggaccgaggggctggaaggtggggagacgcccgaatctcacctgtgaccgtgagcctggtgcccggcccgaagtactgctcgtgtcgactcaagccttcggtacttcactgctggcacacaagtacacagatgtctgggagggagcagccgacaccagcctgagtgggaaatcctctgtgtttaatctagagacattgtagccattggggacttctttgtcagtagtaccagcagcagctgagtagtaaatcagtctcagccccatgcctgggtcttgtcgataccaggacatgtatccatggttcatatcctgggcacactgcagtgtcatgctctgtcctgtcttcaggatgtggaattttggggtctgagtgacaccagcattcacgggacctgcagagaagaactcaagccttcggtactctgagcgggctggcaaggc

SEQ ID NO: 300 - DNA, 495 bp, Artificial Sequence
  Oligonucleotide
gcctccctcgcgccatcagagagtgtcccatggatctgtggacccacttttccctgtgacggatctgcaaaagaacctgaaaaatgtcttacctacaactgtgagtctggtgccttgtccaaagaaagcttcagtgtcgacagagtgtcccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagagagtgtcccatggatctgagcgggctggcaaggc

SEQ ID NO: 301 - DNA, 495 bp, Artificial Sequence
  Oligonucleotide
gcctccctcgcgccatcaggttccgaaccatggatatttcccaggacagagtcctccctcatcgcacccctcctagagacccccagccttacctacaacggttaacctggtccccgaaccgaaggtgtagccatagtcgacgttccgaaccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaaggttccgaaccatggatctgagcgggctggcaaggc

SEQ ID NO: 302 - DNA, 495 bp, Artificial Sequence
  Oligonucleotide
gcctccctcgcgccatcagcgttacttccatggatctggattccagcccctttttgcaagttcccagctgtccagccttgacttactcacctacaacagtgagccaacttccctctccaaaatatatggtgtttcgtcgaccgttacttccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagcgttacttccatggatctgagcgggctggcaaggc

SEQ ID NO: 303 - DNA, 495 bp, Artificial Sequence
  Oligonucleotide
gcctccctcgcgccatcagtaggagacccatggatctcctggaactccgaccttatgatacactatcccgaaagaagtcttttacatacccaagacagagagctgggttccactgccaaaaaacagtttttcattgtcgactaggagacccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagtaggagacccatggatctgagcgggctggcaaggc

SEQ ID NO: 304 - DNA, 495 bp, Artificial Sequence
  Oligonucleotide
gcctccctcgcgccatcaggacactctccatggatagagaactctgccttcaagggacaatggccataccaccctgattctgcaacttacctaggatggagagtcgagtcccatcaccaaaatgctggggctgatgtcgacgacactctccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaaggacactctccatggatctgagcgggctggcaaggc

SEQ ID NO: 305 - DNA, 495 bp, Artificial Sequence
  Oligonucleotide
gcctccctcgcgccatcagttcggaacccatggatatcattgcagtcaaacccaggcacccccgagtcaagagtggagcccccatacctgtcacagtgagcctggtcccgttcccaaagtggaggggtgaattatgtcgacttcggaacccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagttcggaacccatggatctgagcgggctggcaaggc

SEQ ID NO: 306 - DNA, 495 bp, Artificial Sequence
  Oligonucleotide
gcctccctcgcgccatcagaagtaacgccatggatgggtcgtgcaggctgggctgctcaccctctctcccacctggagcccccttcttacctagcacggtgagccgtgtccctggcccgaagaactgctcattgtgtcgacaagtaacgccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagaagtaacgccatggatctgagcgggctggcaaggc

SEQ ID NO: 307 - DNA, 495 bp, Artificial Sequence
  Oligonucleotide
gcctccctcgcgccatcaggtctcctaccatggatcctctgcccatcccgccctctcggagctctccggagccccaaccgcctccttacccagtacggtcagcctagagccttctccaaaaaacagctccccggtgtcgacgtctcctaccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaaggtctcctaccatggatctgagcgggctggcaaggc

SEQ ID NO: 308 - DNA, 495 bp, Artificial Sequence
  Oligonucleotide
gcctccctcgcgccatcaggtagacacccatggatgcgtcccggggcgccccctccccagttccggggcttcagcgggagcccccgcttaccgagcactgtcagccgggtgcctgggccaaaatactgcgtatctgtcgacgtagacacccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaaggtagacacccatggatctgagcgggctggcaaggc

SEQ ID NO: 309 - DNA, 495 bp, Artificial Sequence
  Oligonucleotide
gcctccctcgcgccatcagcactgtacccatggatcgcacaaaaacccgagcgcagtctcgtccccggtcccccggcggccccagcttacccagcactgagagccgggtcccggcgccgaagtactgaatgttttgtcgaccactgtacccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagcactgtacccatggatctgagcgggctggcaaggc

SEQ ID NO: 310 - DNA, 495 bp, Artificial Sequence
  Oligonucleotide
gcctccctcgcgccatcaggatgatccccatggatccccgcaaaaaccagacccaagccgcccgcgcccgcgccccagcagcccgcgctcaccgagcaccaggagccgcgtgcctggcccgaagtactgggtctcgtcgacgatgatccccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaaggatgatccccatggatctgagcgggctggcaaggc

SEQ ID NO: 311 - DNA, 495 bp, Artificial Sequence
  Oligonucleotide
gcctccctcgcgccatcagcgccaataccatggatccgccgccttccacctgaatcccgccgcccgggtggtcccgcgaaaactcacccagcacggtcagcctgctgccggccccgaaagtcaggacgttggcccgtcgaccgccaataccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagcgccaataccatggatctgagcgggctggcaaggc

SEQ ID NO: 312 - DNA, 495 bp, Artificial Sequence
  Oligonucleotide
gcctccctcgcgccatcagtcaagcctccatggatccaccctccgactccggggaccgaggggctggaaggtggggagacgcccgaatctcacctgtgaccgtgagcctggtgcccggcccgaagtactgctcgtgtcgactcaagcctccatggattcactgctggcacagaagtatacagatgtctgggagggagcagctgactccagcctgagcgggaaatcctctgtgtttgatctggatacattgtagccatcggggacttctcctttgtcagtgataccagcagcaactgagtaatgaatgcgcctcagccccatgcctgggtcttgtcgataccaggacaagtatccatggttcatatcctgggcacactgcagtgtcatgctctgtcctgtcttcaggatgtggaattttggggtctgagtgacaccagcattcactggacctgcagagaagtcaagcctccatggatctgagcgggctggcaaggc

SEQ ID NO: 313 - DNA, 495 bp, Artificial Sequence
  Oligonucleotide
gcctccctcgcgccatcagagagtgtcactgctacctgtggacccacttttccctgtgacggatctgcaaaagaacctgaaaaatgtcttacctacaactgtgagtctggtgccttgtccaaagaaagcttcagtgtcgacagagtgtcactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagagagtgtcactgctacctgagcgggctggcaaggc

SEQ ID NO: 314 - DNA, 495 bp, Artificial Sequence
  Oligonucleotide
gcctccctcgcgccatcaggttccgaaactgctacatttcccaggacagagtcctccctcatcgcacccctcctagagacccccagccttacctacaacggttaacctggtccccgaaccgaaggtgtagccatagtcgacgttccgaaactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggaggttccgaaactgctacctgagcgggctggcaaggc

SEQ ID NO: 315 - DNA, 495 bp, Artificial Sequence
  Oligonucleotide
gcctccctcgcgccatcagcgttacttactgctacctggattccagcccctttttgcaagttcccagctgtccagccttgacttactcacctacaacagtgagccaacttccctctccaaaatatatggtgtttcgtcgaccgttacttactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagcgttacttactgctacctgagcgggctggcaaggc

SEQ ID NO: 316 - DNA, 495 bp, Artificial Sequence
  Oligonucleotide
gcctccctcgcgccatcagtaggagacactgctacctcctggaactccgaccttatgatacactatcccgaaagaagtcttttacatacccaagacagagagctgggttccactgccaaaaaacagtttttcattgtcgactaggagacactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagtaggagacactgctacctgagcgggctggcaaggc

SEQ ID NO: 317 - DNA, 495 bp, Artificial Sequence
  Oligonucleotide
gcctccctcgcgccatcaggacactctactgctacagagaactctgccttcaagggacaatggccataccaccctgattctgcaacttacctaggatggagagtcgagtcccatcaccaaaatgctggggctgatgtcgacgacactctactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggaggacactctactgctacctgagcgggctggcaaggc

SEQ ID NO: 318 - DNA, 495 bp, Artificial Sequence
  Oligonucleotide
gcctccctcgcgccatcagttcggaacactgctacatcattgcagtcaaacccaggcacccccgagtcaagagtggagcccccatacctgtcacagtgagcctggtcccgttcccaaagtggaggggtgaattatgtcgacttcggaacactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagttcggaacactgctacctgagcgggctggcaaggc

SEQ ID NO: 319 - DNA, 495 bp, Artificial Sequence
  Oligonucleotide
gcctccctcgcgccatcagaagtaacgactgctacgggtcgtgcaggctgggctgctcaccctctctcccacctggagcccccttcttacctagcacggtgagccgtgtccctggcccgaagaactgctcattgtgtcgacaagtaacgactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagaagtaacgactgctacctgagcgggctggcaaggc

SEQ ID NO: 320 - DNA, 495 bp, Artificial Sequence
  Oligonucleotide
gcctccctcgcgccatcaggtctcctaactgctaccctctgcccatcccgccctctcggagctctccggagccccaaccgcctccttacccagtacggtcagcctagagccttctccaaaaaacagctccccggtgtcgacgtctcctaactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggaggtctcctaactgctacctgagcgggctggcaaggc

SEQ ID NO: 321 - DNA, 495 bp, Artificial Sequence
  Oligonucleotide
gcctccctcgcgccatcaggtagacacactgctacgcgtcccggggcgccccctccccagttccggggcttcagcgggagcccccgcttaccgagcactgtcagccgggtgcctgggccaaaatactgcgtatctgtcgacgtagacacactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggaggtagacacactgctacctgagcgggctggcaaggc

SEQ ID NO: 322 - DNA, 495 bp, Artificial Sequence
  Oligonucleotide
gcctccctcgcgccatcagcactgtacactgctaccgcacaaaaacccgagcgcagtctcgtccccggtcccccggcggccccagcttacccagcactgagagccgggtcccggcgccgaagtactgaatgttttgtcgaccactgtacactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagcactgtacactgctacctgagcgggctggcaaggc

SEQ ID NO: 323 - DNA, 495 bp, Artificial Sequence
  Oligonucleotide
gcctccctcgcgccatcaggatgatccactgctacccccgcaaaaaccagacccaagccgcccgcgcccgcgccccagcagcccgcgctcaccgagcaccaggagccgcgtgcctggcccgaagtactgggtctcgtcgacgatgatccactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggaggatgatccactgctacctgagcgggctggcaaggc

SEQ ID NO: 324 - DNA, 495 bp, Artificial Sequence
  Oligonucleotide
gcctccctcgcgccatcagcgccaataactgctacccgccgccttccacctgaatcccgccgcccgggtggtcccgcgaaaactcacccagcacggtcagcctgctgccggccccgaaagtcaggacgttggcccgtcgaccgccaataactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagcgccaataactgctacctgagcgggctggcaaggc

SEQ ID NO: 325 - DNA, 495 bp, Artificial Sequence
  Oligonucleotide
gcctccctcgcgccatcagtcaagcctactgctacccaccctccgactccggggaccgaggggctggaaggtggggagacgcccgaatctcacctgtgaccgtgagcctggtgcccggcccgaagtactgctcgtgtcgactcaagcctactgctactcactgctggcacagagatacacagccaagtccccctgctgtgtgcgctggaacttcagagtggagatggatccctcagacctctgtgcagagaaccgatcacggggaagccccgatttgtctgctgcatccttgccttggaagtaaattggaaactccaggccctgccccaggctctgtcggtaccaataaagggcattatgacctgaaattggatcatatctgagagctacatcctttcccttctttgctaccttgtgtctcagggactgggagactccagcacctgtgtgatctgtggagtcaagcctactgctacctgagcgggctggcaaggc

SEQ ID NO: 326 - DNA, 495 bp, Artificial Sequence
  Oligonucleotide
gcctccctcgcgccatcagagagtgtcacgaagatctgtggacccacttttccctgtgacggatctgcaaaagaacctgaaaaatgtcttacctacaactgtgagtctggtgccttgtccaaagaaagcttcagtgtcgacagagtgtcacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagagagtgtcacgaagatctgagcgggctggcaaggc

SEQ ID NO: 327 - DNA, 495 bp, Artificial Sequence
  Oligonucleotide
gcctccctcgcgccatcaggttccgaaacgaagatatttcccaggacagagtcctccctcatcgcacccctcctagagacccccagccttacctacaacggttaacctggtccccgaaccgaaggtgtagccatagtcgacgttccgaaacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggaggttccgaaacgaagatctgagcgggctggcaaggc

SEQ ID NO: 328 - DNA, 495 bp, Artificial Sequence
  Oligonucleotide
gcctccctcgcgccatcagcgttacttacgaagatctggattccagcccctttttgcaagttcccagctgtccagccttgacttactcacctacaacagtgagccaacttccctctccaaaatatatggtgtttcgtcgaccgttacttacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagcgttacttacgaagatctgagcgggctggcaaggc

SEQ ID NO: 329 - DNA, 495 bp, Artificial Sequence
  Oligonucleotide
gcctccctcgcgccatcagtaggagacacgaagatctcctggaactccgaccttatgatacactatcccgaaagaagtcttttacatacccaagacagagagctgggttccactgccaaaaaacagtttttcattgtcgactaggagacacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagtaggagacacgaagatctgagcgggctggcaaggc

SEQ ID NO: 330 - DNA, 495 bp, Artificial Sequence
  Oligonucleotide
gcctccctcgcgccatcaggacactctacgaagatagagaactctgccttcaagggacaatggccataccaccctgattctgcaacttacctaggatggagagtcgagtcccatcaccaaaatgctggggctgatgtcgacgacactctacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggaggacactctacgaagatctgagcgggctggcaaggc

SEQ ID NO: 331 - DNA, 495 bp, Artificial Sequence
  Oligonucleotide
gcctccctcgcgccatcagttcggaacacgaagatatcattgcagtcaaacccaggcacccccgagtcaagagtggagcccccatacctgtcacagtgagcctggtcccgttcccaaagtggaggggtgaattatgtcgacttcggaacacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagttcggaacacgaagatctgagcgggctggcaaggc

SEQ ID NO: 332 - DNA, 495 bp, Artificial Sequence
  Oligonucleotide
gcctccctcgcgccatcagaagtaacgacgaagatgggtcgtgcaggctgggctgctcaccctctctcccacctggagcccccttcttacctagcacggtgagccgtgtccctggcccgaagaactgctcattgtgtcgacaagtaacgacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagaagtaacgacgaagatctgagcgggctggcaaggc

SEQ ID NO: 333 - DNA, 495 bp, Artificial Sequence
  Oligonucleotide
gcctccctcgcgccatcaggtctcctaacgaagatcctctgcccatcccgccctctcggagctctccggagccccaaccgcctccttacccagtacggtcagcctagagccttctccaaaaaacagctccccggtgtcgacgtctcctaacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggaggtctcctaacgaagatctgagcgggctggcaaggc

SEQ ID NO: 334 - DNA, 495 bp, Artificial Sequence
  Oligonucleotide
gcctccctcgcgccatcaggtagacacacgaagatgcgtcccggggcgccccctccccagttccggggcttcagcgggagcccccgcttaccgagcactgtcagccgggtgcctgggccaaaatactgcgtatctgtcgacgtagacacacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggaggtagacacacgaagatctgagcgggctggcaaggc

SEQ ID NO: 335 - DNA, 495 bp, Artificial Sequence
  Oligonucleotide
gcctccctcgcgccatcagcactgtacacgaagatcgcacaaaaacccgagcgcagtctcgtccccggtcccccggcggccccagcttacccagcactgagagccgggtcccggcgccgaagtactgaatgttttgtcgaccactgtacacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagcactgtacacgaagatctgagcgggctggcaaggc

SEQ ID NO: 336 - DNA, 495 bp, Artificial Sequence
  Oligonucleotide
gcctccctcgcgccatcaggatgatccacgaagatccccgcaaaaaccagacccaagccgcccgcgcccgcgccccagcagcccgcgctcaccgagcaccaggagccgcgtgcctggcccgaagtactgggtctcgtcgacgatgatccacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggaggatgatccacgaagatctgagcgggctggcaaggc

SEQ ID NO: 337 - DNA, 495 bp, Artificial Sequence
  Oligonucleotide
gcctccctcgcgccatcagcgccaataacgaagatccgccgccttccacctgaatcccgccgcccgggtggtcccgcgaaaactcacccagcacggtcagcctgctgccggccccgaaagtcaggacgttggcccgtcgaccgccaataacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagcgccaataacgaagatctgagcgggctggcaaggc

SEQ ID NO: 338 - DNA, 495 bp, Artificial Sequence
  Oligonucleotide
gcctccctcgcgccatcagtcaagcctacgaagatccaccctccgactccggggaccgaggggctggaaggtggggagacgcccgaatctcacctgtgaccgtgagcctggtgcccggcccgaagtactgctcgtgtcgactcaagcctacgaagattcactgctggcacagagatacacggccgagtcctcctgctgtgtgcgctggatcgtcagagtggagacggatcccccagtcctctctgcagagaagcgatcactgggcagccctgatttgtctggtgcactgttgccttggaagtaaattaaaaactccaggccctgccccaggctctgtcggtaccagtaaagggcagtatgacctgaaattggatcacacctgagctctacatcctttcccttctctgtgaccttgttactgggggactgggagactccagctcctgtgtgatctgtggagtcaagcctacgaagatctgagcgggctggcaaggc

SEQ ID NO: 339 - DNA, 495 bp, Artificial Sequence
  Oligonucleotide
gcctccctcgcgccatcagagagtgtcactgtggactgtggacccacttttccctgtgacggatctgcaaaagaacctgaaaaatgtcttacctacaactgtgagtctggtgccttgtccaaagaaagcttcagtgtcgacagagtgtcactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagagagtgtcactgtggactgagcgggctggcaaggc

SEQ ID NO: 340 - DNA, 495 bp, Artificial Sequence
  Oligonucleotide
gcctccctcgcgccatcaggttccgaaactgtggaatttcccaggacagagtcctccctcatcgcacccctcctagagacccccagccttacctacaacggttaacctggtccccgaaccgaaggtgtagccatagtcgacgttccgaaactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggaggttccgaaactgtggactgagcgggctggcaaggc

SEQ ID NO: 341 - DNA, 495 bp, Artificial Sequence
  Oligonucleotide
gcctccctcgcgccatcagcgttacttactgtggactggattccagcccctttttgcaagttcccagctgtccagccttgacttactcacctacaacagtgagccaacttccctctccaaaatatatggtgtttcgtcgaccgttacttactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagcgttacttactgtggactgagcgggctggcaaggc

SEQ ID NO: 342 - DNA, 495 bp, Artificial Sequence
  Oligonucleotide
gcctccctcgcgccatcagtaggagacactgtggactcctggaactccgaccttatgatacactatcccgaaagaagtcttttacatacccaagacagagagctgggttccactgccaaaaaacagtttttcattgtcgactaggagacactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagtaggagacactgtggactgagcgggctggcaaggc

SEQ ID NO: 343 - DNA, 495 bp, Artificial Sequence
  Oligonucleotide
gcctccctcgcgccatcaggacactctactgtggaagagaactctgccttcaagggacaatggccataccaccctgattctgcaacttacctaggatggagagtcgagtcccatcaccaaaatgctggggctgatgtcgacgacactctactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggaggacactctactgtggactgagcgggctggcaaggc

SEQ ID NO: 344 - DNA, 495 bp, Artificial Sequence
  Oligonucleotide
gcctccctcgcgccatcagttcggaacactgtggaatcattgcagtcaaacccaggcacccccgagtcaagagtggagcccccatacctgtcacagtgagcctggtcccgttcccaaagtggaggggtgaattatgtcgacttcggaacactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagttcggaacactgtggactgagcgggctggcaaggc

SEQ ID NO: 345 - DNA, 495 bp, Artificial Sequence
  Oligonucleotide
gcctccctcgcgccatcagaagtaacgactgtggagggtcgtgcaggctgggctgctcaccctctctcccacctggagcccccttcttacctagcacggtgagccgtgtccctggcccgaagaactgctcattgtgtcgacaagtaacgactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagaagtaacgactgtggactgagcgggctggcaaggc

SEQ ID NO: 346 - DNA, 495 bp, Artificial Sequence
  Oligonucleotide
gcctccctcgcgccatcaggtctcctaactgtggacctctgcccatcccgccctctcggagctctccggagccccaaccgcctccttacccagtacggtcagcctagagccttctccaaaaaacagctccccggtgtcgacgtctcctaactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggaggtctcctaactgtggactgagcgggctggcaaggc

SEQ ID NO: 347 - DNA, 495 bp, Artificial Sequence
  Oligonucleotide
gcctccctcgcgccatcaggtagacacactgtggagcgtcccggggcgccccctccccagttccggggcttcagcgggagcccccgcttaccgagcactgtcagccgggtgcctgggccaaaatactgcgtatctgtcgacgtagacacactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggaggtagacacactgtggactgagcgggctggcaaggc

SEQ ID NO: 348 - DNA, 495 bp, Artificial Sequence
  Oligonucleotide
gcctccctcgcgccatcagcactgtacactgtggacgcacaaaaacccgagcgcagtctcgtccccggtcccccggcggccccagcttacccagcactgagagccgggtcccggcgccgaagtactgaatgttttgtcgaccactgtacactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagcactgtacactgtggactgagcgggctggcaaggc

SEQ ID NO: 349 - DNA, 495 bp, Artificial Sequence
  Oligonucleotide
gcctccctcgcgccatcaggatgatccactgtggaccccgcaaaaaccagacccaagccgcccgcgcccgcgccccagcagcccgcgctcaccgagcaccaggagccgcgtgcctggcccgaagtactgggtctcgtcgacgatgatccactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggaggatgatccactgtggactgagcgggctggcaaggc

SEQ ID NO: 350 - DNA, 495 bp, Artificial Sequence
  Oligonucleotide
gcctccctcgcgccatcagcgccaataactgtggaccgccgccttccacctgaatcccgccgcccgggtggtcccgcgaaaactcacccagcacggtcagcctgctgccggccccgaaagtcaggacgttggcccgtcgaccgccaataactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagcgccaataactgtggactgagcgggctggcaaggc

SEQ ID NO: 351 - DNA, 495 bp, Artificial Sequence
  Oligonucleotide
gcctccctcgcgccatcagtcaagcctactgtggaccaccctccgactccggggaccgaggggctggaaggtggggagacgcccgaatctcacctgtgaccgtgagcctggtgcccggcccgaagtactgctcgtgtcgactcaagcctactgtggatcactgctggcacagagatacacggctgagtccccccgctctgtgcgctggatcttcagagtagagacggatccctcaggcctgactgcaaagaaccgatcgttgggcagccctgagtcatctgccgcacccgtgccttggaagtaaattagaaactctgggccctgccccaggctttgtcggtaccagtaaagggcagtatgacctgaaattggatcacacctgagctctacatattttcccttctctgtgaccttgttactgggggtctgggagactccagcacctgtgtgatctgcggagtcaagcctactgtggactgagcgggctggcaaggc

SEQ ID NO: 352 - DNA, 495 bp, Artificial Sequence
  Oligonucleotide
gcctccctcgcgccatcagagagtgtcggtgtcatctgtggacccacttttccctgtgacggatctgcaaaagaacctgaaaaatgtcttacctacaactgtgagtctggtgccttgtccaaagaaagcttcagtgtcgacagagtgtcggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaaagagtgtcggtgtcatctgagcgggctggcaaggc

SEQ ID NO: 353 - DNA, 495 bp, Artificial Sequence
  Oligonucleotide
gcctccctcgcgccatcaggttccgaaggtgtcatatttcccaggacagagtcctccctcatcgcacccctcctagagacccccagccttacctacaacggttaacctggtccccgaaccgaaggtgtagccatagtcgacgttccgaaggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaagttccgaaggtgtcatctgagcgggctggcaaggc

SEQ ID NO: 354 - DNA, 495 bp, Artificial Sequence
  Oligonucleotide
gcctccctcgcgccatcagcgttacttggtgtcatctggattccagcccctttttgcaagttcccagctgtccagccttgacttactcacctacaacagtgagccaacttccctctccaaaatatatggtgtttcgtcgaccgttacttggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaacgttacttggtgtcatctgagcgggctggcaaggc

SEQ ID NO: 355 - DNA, 495 bp, Artificial Sequence
  Oligonucleotide
gcctccctcgcgccatcagtaggagacggtgtcatctcctggaactccgaccttatgatacactatcccgaaagaagtcttttacatacccaagacagagagctgggttccactgccaaaaaacagtttttcattgtcgactaggagacggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaataggagacggtgtcatctgagcgggctggcaaggc

SEQ ID NO: 356 - DNA, 495 bp, Artificial Sequence
  Oligonucleotide
gcctccctcgcgccatcaggacactctggtgtcatagagaactctgccttcaagggacaatggccataccaccctgattctgcaacttacctaggatggagagtcgagtcccatcaccaaaatgctggggctgatgtcgacgacactctggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaagacactctggtgtcatctgagcgggctggcaaggc

SEQ ID NO: 357 - DNA, 495 bp, Artificial Sequence
  Oligonucleotide
gcctccctcgcgccatcagttcggaacggtgtcatatcattgcagtcaaacccaggcacccccgagtcaagagtggagcccccatacctgtcacagtgagcctggtcccgttcccaaagtggaggggtgaattatgtcgacttcggaacggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaattcggaacggtgtcatctgagcgggctggcaaggc

SEQ ID NO: 358 - DNA, 495 bp, Artificial Sequence
  Oligonucleotide
gcctccctcgcgccatcagaagtaacgggtgtcatgggtcgtgcaggctgggctgctcaccctctctcccacctggagcccccttcttacctagcacggtgagccgtgtccctggcccgaagaactgctcattgtgtcgacaagtaacgggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaaaagtaacgggtgtcatctgagcgggctggcaaggc

SEQ ID NO: 359 - DNA, 495 bp, Artificial Sequence
  Oligonucleotide
gcctccctcgcgccatcaggtctcctaggtgtcatcctctgcccatcccgccctctcggagctctccggagccccaaccgcctccttacccagtacggtcagcctagagccttctccaaaaaacagctccccggtgtcgacgtctcctaggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaagtctcctaggtgtcatctgagcgggctggcaaggc

SEQ ID NO: 360 - DNA, 495 bp, Artificial Sequence
  Oligonucleotide
gcctccctcgcgccatcaggtagacacggtgtcatgcgtcccggggcgccccctccccagttccggggcttcagcgggagcccccgcttaccgagcactgtcagccgggtgcctgggccaaaatactgcgtatctgtcgacgtagacacggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaagtagacacggtgtcatctgagcgggctggcaaggc

SEQ ID NO: 361 - DNA, 495 bp, Artificial Sequence
  Oligonucleotide
gcctccctcgcgccatcagcactgtacggtgtcatcgcacaaaaacccgagcgcagtctcgtccccggtcccccggcggccccagcttacccagcactgagagccgggtcccggcgccgaagtactgaatgttttgtcgaccactgtacggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaacactgtacggtgtcatctgagcgggctggcaaggc

SEQ ID NO: 362 - DNA, 495 bp, Artificial Sequence
  Oligonucleotide
gcctccctcgcgccatcaggatgatccggtgtcatccccgcaaaaaccagacccaagccgcccgcgcccgcgccccagcagcccgcgctcaccgagcaccaggagccgcgtgcctggcccgaagtactgggtctcgtcgacgatgatccggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaagatgatccggtgtcatctgagcgggctggcaaggc

SEQ ID NO: 363 - DNA, 495 bp, Artificial Sequence
  Oligonucleotide
gcctccctcgcgccatcagcgccaataggtgtcatccgccgccttccacctgaatcccgccgcccgggtggtcccgcgaaaactcacccagcacggtcagcctgctgccggccccgaaagtcaggacgttggcccgtcgaccgccaataggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaacgccaataggtgtcatctgagcgggctggcaaggc

SEQ ID NO: 364 - DNA, 495 bp, Artificial Sequence
  Oligonucleotide
gcctccctcgcgccatcagtcaagcctggtgtcatccaccctccgactccggggaccgaggggctggaaggtggggagacgcccgaatctcacctgtgaccgtgagcctggtgcccggcccgaagtactgctcgtgtcgactcaagcctggtgtcattcactgctggcacagagatacacagctgagtccccctgctctgtgcgctggatcttcagagtggagacggatctctcaggcctctctgcagagaaccgaccactgggccgccctgatttgtctcgttgagcatcactctgggagtaagtcagaacctctgagccctgccccagggtctgtcggtaccaataaagggttacatgacccgaaattgaatcacacctgagagctacatcccgtcccctctttgcgactttgtaccttggggactgggagactccagcacctgtgtgatctgtggaatcaagcctggtgtcatctgagcgggctggcaaggc

SEQ ID NO: 365 - DNA, 495 bp, Artificial Sequence
  Oligonucleotide
gcctccctcgcgccatcagagagtgtctcgtgaagctgtggacccacttttccctgtgacggatctgcaaaagaacctgaaaaatgtcttacctacaactgtgagtctggtgccttgtccaaagaaagcttcagtgtcgacagagtgtctcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaaagagtgtctcgtgaagctgagcgggctggcaaggc

SEQ ID NO: 366 - DNA, 495 bp, Artificial Sequence
  Oligonucleotide
gcctccctcgcgccatcaggttccgaatcgtgaagatttcccaggacagagtcctccctcatcgcacccctcctagagacccccagccttacctacaacggttaacctggtccccgaaccgaaggtgtagccatagtcgacgttccgaatcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaagttccgaatcgtgaagctgagcgggctggcaaggc

SEQ ID NO: 367 - DNA, 495 bp, Artificial Sequence
  Oligonucleotide
gcctccctcgcgccatcagcgttactttcgtgaagctggattccagcccctttttgcaagttcccagctgtccagccttgacttactcacctacaacagtgagccaacttccctctccaaaatatatggtgtttcgtcgaccgttactttcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaacgttactttcgtgaagctgagcgggctggcaaggc

SEQ ID NO: 368 - DNA, 495 bp, Artificial Sequence
  Oligonucleotide
gcctccctcgcgccatcagtaggagactcgtgaagctcctggaactccgaccttatgatacactatcccgaaagaagtcttttacatacccaagacagagagctgggttccactgccaaaaaacagtttttcattgtcgactaggagactcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaataggagactcgtgaagctgagcgggctggcaaggc

SEQ ID NO: 369 - DNA, 495 bp, Artificial Sequence
  Oligonucleotide
gcctccctcgcgccatcaggacactcttcgtgaagagagaactctgccttcaagggacaatggccataccaccctgattctgcaacttacctaggatggagagtcgagtcccatcaccaaaatgctggggctgatgtcgacgacactcttcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaagacactcttcgtgaagctgagcgggctggcaaggc

SEQ ID NO: 370 - DNA, 495 bp, Artificial Sequence
  Oligonucleotide
gcctccctcgcgccatcagttcggaactcgtgaagatcattgcagtcaaacccaggcacccccgagtcaagagtggagcccccatacctgtcacagtgagcctggtcccgttcccaaagtggaggggtgaattatgtcgacttcggaactcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaattcggaactcgtgaagctgagcgggctggcaaggc

SEQ ID NO: 371 - DNA, 495 bp, Artificial Sequence
  Oligonucleotide
gcctccctcgcgccatcagaagtaacgtcgtgaaggggtcgtgcaggctgggctgctcaccctctctcccacctggagcccccttcttacctagcacggtgagccgtgtccctggcccgaagaactgctcattgtgtcgacaagtaacgtcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaaaagtaacgtcgtgaagctgagcgggctggcaaggc

SEQ ID NO: 372 - DNA, 495 bp, Artificial Sequence
  Oligonucleotide
gcctccctcgcgccatcaggtctcctatcgtgaagcctctgcccatcccgccctctcggagctctccggagccccaaccgcctccttacccagtacggtcagcctagagccttctccaaaaaacagctccccggtgtcgacgtctcctatcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaagtctcctatcgtgaagctgagcgggctggcaaggc

SEQ ID NO: 373 - DNA, 495 bp, Artificial Sequence
  Oligonucleotide
gcctccctcgcgccatcaggtagacactcgtgaaggcgtcccggggcgccccctccccagttccggggcttcagcgggagcccccgcttaccgagcactgtcagccgggtgcctgggccaaaatactgcgtatctgtcgacgtagacactcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaagtagacactcgtgaagctgagcgggctggcaaggc

SEQ ID NO: 374 - DNA, 495 bp, Artificial Sequence
  Oligonucleotide
gcctccctcgcgccatcagcactgtactcgtgaagcgcacaaaaacccgagcgcagtctcgtccccggtcccccggcggccccagcttacccagcactgagagccgggtcccggcgccgaagtactgaatgttttgtcgaccactgtactcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaacactgtactcgtgaagctgagcgggctggcaaggc

SEQ ID NO: 375 - DNA, 495 bp, Artificial Sequence
  Oligonucleotide
gcctccctcgcgccatcaggatgatcctcgtgaagccccgcaaaaaccagacccaagccgcccgcgcccgcgccccagcagcccgcgctcaccgagcaccaggagccgcgtgcctggcccgaagtactgggtctcgtcgacgatgatcctcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaagatgatcctcgtgaagctgagcgggctggcaaggc

SEQ ID NO: 376 - DNA, 495 bp, Artificial Sequence
  Oligonucleotide
gcctccctcgcgccatcagcgccaatatcgtgaagccgccgccttccacctgaatcccgccgcccgggtggtcccgcgaaaactcacccagcacggtcagcctgctgccggccccgaaagtcaggacgttggcccgtcgaccgccaatatcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaacgccaatatcgtgaagctgagcgggctggcaaggc

SEQ ID NO: 377 - DNA, 495 bp, Artificial Sequence
  Oligonucleotide
gcctccctcgcgccatcagtcaagccttcgtgaagccaccctccgactccggggaccgaggggctggaaggtggggagacgcccgaatctcacctgtgaccgtgagcctggtgcccggcccgaagtactgctcgtgtcgactcaagccttcgtgaagtcacttctggcacagagatacacagccgagtcgcccttgctctgtgcgctggatcttcaggtggagaaagatcctcagacctctctgtggagaattgatcactgagcagccctgatttatcttgttgagtttcatcctggaaggaagtcagaaactcttggccctgccccagggtctgtcggtaccaataaagggttacctgacccgaaattggatcacacctgggagctacatcctgtcccctctgtgtgacttcgtaccttggggactgggagactccagcacctgtgtgatctgtggaaatcaagccttcgtgaagctgagcgggctggcaaggc

SEQ ID NO: 378 - DNA, 495 bp, Artificial Sequence
  Oligonucleotide
gcctccctcgcgccatcagagagtgtccactagctctgtggacccacttttccctgtgacggatctgcaaaagaacctgaaaaatgtcttacctacaactgtgagtctggtgccttgtccaaagaaagcttcagtgtcgacagagtgtccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaaagagtgtccactagctctgagcgggctggcaaggc

SEQ ID NO: 379 - DNA, 495 bp, Artificial Sequence
  Oligonucleotide
gcctccctcgcgccatcaggttccgaacactagctatttcccaggacagagtcctccctcatcgcacccctcctagagacccccagccttacctacaacggttaacctggtccccgaaccgaaggtgtagccatagtcgacgttccgaacactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaagttccgaacactagctctgagcgggctggcaaggc

SEQ ID NO: 380 - DNA, 495 bp, Artificial Sequence
  Oligonucleotide
gcctccctcgcgccatcagcgttacttcactagctctggattccagcccctttttgcaagttcccagctgtccagccttgacttactcacctacaacagtgagccaacttccctctccaaaatatatggtgtttcgtcgaccgttacttcactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaacgttacttcactagctctgagcgggctggcaaggc

SEQ ID NO: 381 - DNA, 495 bp, Artificial Sequence
  Oligonucleotide
gcctccctcgcgccatcagtaggagaccactagctctcctggaactccgaccttatgatacactatcccgaaagaagtcttttacatacccaagacagagagctgggttccactgccaaaaaacagtttttcattgtcgactaggagaccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaataggagaccactagctctgagcgggctggcaaggc

SEQ ID NO: 382 - DNA, 495 bp, Artificial Sequence
  Oligonucleotide
gcctccctcgcgccatcaggacactctcactagctagagaactctgccttcaagggacaatggccataccaccctgattctgcaacttacctaggatggagagtcgagtcccatcaccaaaatgctggggctgatgtcgacgacactctcactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaagacactctcactagctctgagcgggctggcaaggc

SEQ ID NO: 383 - DNA, 495 bp, Artificial Sequence
  Oligonucleotide
gcctccctcgcgccatcagttcggaaccactagctatcattgcagtcaaacccaggcacccccgagtcaagagtggagcccccatacctgtcacagtgagcctggtcccgttcccaaagtggaggggtgaattatgtcgacttcggaaccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaattcggaaccactagctctgagcgggctggcaaggc

SEQ ID NO: 384 - DNA, 495 bp, Artificial Sequence
  Oligonucleotide
gcctccctcgcgccatcagaagtaacgcactagctgggtcgtgcaggctgggctgctcaccctctctcccacctggagcccccttcttacctagcacggtgagccgtgtccctggcccgaagaactgctcattgtgtcgacaagtaacgcactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaaaagtaacgcactagctctgagcgggctggcaaggc

SEQ ID NO: 385 - DNA, 495 bp, Artificial Sequence
  Oligonucleotide
gcctccctcgcgccatcaggtctcctacactagctcctctgcccatcccgccctctcggagctctccggagccccaaccgcctccttacccagtacggtcagcctagagccttctccaaaaaacagctccccggtgtcgacgtctcctacactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaagtctcctacactagctctgagcgggctggcaaggc

SEQ ID NO: 386 - DNA, 495 bp, Artificial Sequence
  Oligonucleotide
gcctccctcgcgccatcaggtagacaccactagctgcgtcccggggcgccccctccccagttccggggcttcagcgggagcccccgcttaccgagcactgtcagccgggtgcctgggccaaaatactgcgtatctgtcgacgtagacaccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaagtagacaccactagctctgagcgggctggcaaggc

SEQ ID NO: 387 - DNA, 495 bp, Artificial Sequence
  Oligonucleotide
gcctccctcgcgccatcagcactgtaccactagctcgcacaaaaacccgagcgcagtctcgtccccggtcccccggcggccccagcttacccagcactgagagccgggtcccggcgccgaagtactgaatgttttgtcgaccactgtaccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaacactgtaccactagctctgagcgggctggcaaggc

SEQ ID NO: 388 - DNA, 495 bp, Artificial Sequence
  Oligonucleotide
gcctccctcgcgccatcaggatgatcccactagctccccgcaaaaaccagacccaagccgcccgcgcccgcgccccagcagcccgcgctcaccgagcaccaggagccgcgtgcctggcccgaagtactgggtctcgtcgacgatgatcccactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaagatgatcccactagctctgagcgggctggcaaggc

SEQ ID NO: 389 - DNA, 495 bp, Artificial Sequence
  Oligonucleotide
gcctccctcgcgccatcagcgccaatacactagctccgccgccttccacctgaatcccgccgcccgggtggtcccgcgaaaactcacccagcacggtcagcctgctgccggccccgaaagtcaggacgttggcccgtcgaccgccaatacactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaacgccaatacactagctctgagcgggctggcaaggc

SEQ ID NO: 390 - DNA, 495 bp, Artificial Sequence
  Oligonucleotide
gcctccctcgcgccatcagtcaagcctcactagctccaccctccgactccggggaccgaggggctggaaggtggggagacgcccgaatctcacctgtgaccgtgagcctggtgcccggcccgaagtactgctcgtgtcgactcaagcctcactagcttcactgctggcacagcgatacatggccgagtcccgctgctctgtgcgctggatcgtcagagtggagatggatccctcaggcctctctgcagagaaccgatcattgggcagccctgatttgtcttgttgggcttcataattgaagtaagtcagaaactctgggccctgccccagggcctgtcggtaccaataaagggatacatgacccgaaattggatcacacctgagagctacatcctgtcccctctttgtgactttgtacctgggagactgggagactccagcacctgtgtgatctgtggaatcaagcctcactagctctgagcgggctggcaaggc

SEQ ID NO: 391 - DNA, 495 bp, Artificial Sequence
  Oligonucleotide
gcctccctcgcgccatcagagagtgtccttggttactgtggacccacttttccctgtgacggatctgcaaaagaacctgaaaaatgtcttacctacaactgtgagtctggtgccttgtccaaagaaagcttcagtgtcgacagagtgtccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaaagagtgtccttggttactgagcgggctggcaaggc

SEQ ID NO: 392 - DNA, 495 bp, Artificial Sequence
  Oligonucleotide
gcctccctcgcgccatcaggttccgaacttggttaatttcccaggacagagtcctccctcatcgcacccctcctagagacccccagccttacctacaacggttaacctggtccccgaaccgaaggtgtagccatagtcgacgttccgaacttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaagttccgaacttggttactgagcgggctggcaaggc

SEQ ID NO: 393 - DNA, 495 bp, Artificial Sequence
  Oligonucleotide
gcctccctcgcgccatcagcgttacttcttggttactggattccagcccctttttgcaagttcccagctgtccagccttgacttactcacctacaacagtgagccaacttccctctccaaaatatatggtgtttcgtcgaccgttacttcttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaacgttacttcttggttactgagcgggctggcaaggc

SEQ ID NO: 394 - DNA, 495 bp, Artificial Sequence
  Oligonucleotide
gcctccctcgcgccatcagtaggagaccttggttactcctggaactccgaccttatgatacactatcccgaaagaagtcttttacatacccaagacagagagctgggttccactgccaaaaaacagtttttcattgtcgactaggagaccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaataggagaccttggttactgagcgggctggcaaggc

SEQ ID NO: 395 - DNA, 495 bp, Artificial Sequence
  Oligonucleotide
gcctccctcgcgccatcaggacactctcttggttaagagaactctgccttcaagggacaatggccataccaccctgattctgcaacttacctaggatggagagtcgagtcccatcaccaaaatgctggggctgatgtcgacgacactctcttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaagacactctcttggttactgagcgggctggcaaggc

SEQ ID NO: 396 - DNA, 495 bp, Artificial Sequence
  Oligonucleotide
gcctccctcgcgccatcagttcggaaccttggttaatcattgcagtcaaacccaggcacccccgagtcaagagtggagcccccatacctgtcacagtgagcctggtcccgttcccaaagtggaggggtgaattatgtcgacttcggaaccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaattcggaaccttggttactgagcgggctggcaaggc

SEQ ID NO: 397 - DNA, 495 bp, Artificial Sequence
  Oligonucleotide
gcctccctcgcgccatcagaagtaacgcttggttagggtcgtgcaggctgggctgctcaccctctctcccacctggagcccccttcttacctagcacggtgagccgtgtccctggcccgaagaactgctcattgtgtcgacaagtaacgcttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaaaagtaacgcttggttactgagcgggctggcaaggc

SEQ ID NO: 398 - DNA, 495 bp, Artificial Sequence
  Oligonucleotide
gcctccctcgcgccatcaggtctcctacttggttacctctgcccatcccgccctctcggagctctccggagccccaaccgcctccttacccagtacggtcagcctagagccttctccaaaaaacagctccccggtgtcgacgtctcctacttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaagtctcctacttggttactgagcgggctggcaaggc

SEQ ID NO: 399 - DNA, 495 bp, Artificial Sequence
  Oligonucleotide
gcctccctcgcgccatcaggtagacaccttggttagcgtcccggggcgccccctccccagttccggggcttcagcgggagcccccgcttaccgagcactgtcagccgggtgcctgggccaaaatactgcgtatctgtcgacgtagacaccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaagtagacaccttggttactgagcgggctggcaaggc

SEQ ID NO: 400 - DNA, 495 bp, Artificial Sequence
  Oligonucleotide
gcctccctcgcgccatcagcactgtaccttggttacgcacaaaaacccgagcgcagtctcgtccccggtcccccggcggccccagcttacccagcactgagagccgggtcccggcgccgaagtactgaatgttttgtcgaccactgtaccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaacactgtaccttggttactgagcgggctggcaaggc

SEQ ID NO: 401 - DNA, 495 bp, Artificial Sequence
  Oligonucleotide
gcctccctcgcgccatcaggatgatcccttggttaccccgcaaaaaccagacccaagccgcccgcgcccgcgccccagcagcccgcgctcaccgagcaccaggagccgcgtgcctggcccgaagtactgggtctcgtcgacgatgatcccttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaagatgatcccttggttactgagcgggctggcaaggc

SEQ ID NO: 402 - DNA, 495 bp, Artificial Sequence
  Oligonucleotide
gcctccctcgcgccatcagcgccaatacttggttaccgccgccttccacctgaatcccgccgcccgggtggtcccgcgaaaactcacccagcacggtcagcctgctgccggccccgaaagtcaggacgttggcccgtcgaccgccaatacttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaacgccaatacttggttactgagcgggctggcaaggc

SEQ ID NO: 403 - DNA, 495 bp, Artificial Sequence
  Oligonucleotide
gcctccctcgcgccatcagtcaagcctcttggttaccaccctccgactccggggaccgaggggctggaaggtggggagacgcccgaatctcacctgtgaccgtgagcctggtgcccggcccgaagtactgctcgtgtcgactcaagcctcttggttatcactgctggcacagcgatacatggctgagtcccgctgctctgtgcgctgaatcgtcagagtggagatggatccctcaggcctctctgcagagaaccgatcactgggcagccctgatttgtctggttgagcttcataattgaagtaagtcagaaactctgggccctgccccagggcctgttgataccaataaagggttgcatgactcgaaattggatcacacctgagagttacatcctgtcccctctttgtgactttgtacctgggagactgggagactccagcacctgtgtgatctgtggaatcaagcctcttggttactgagcgggctggcaaggc

SEQ ID NO: 404 - DNA, 495 bp, Artificial Sequence
  Oligonucleotide
gcctccctcgcgccatcagagagtgtcacctcttgctgtggacccacttttccctgtgacggatctgcaaaagaacctgaaaaatgtcttacctacaactgtgagtctggtgccttgtccaaagaaagcttcagtgtcgacagagtgtcacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaaagagtgtcacctcttgctgagcgggctggcaaggc

SEQ ID NO: 405 - DNA, 495 bp, Artificial Sequence
  Oligonucleotide
gcctccctcgcgccatcaggttccgaaacctcttgatttcccaggacagagtcctccctcatcgcacccctcctagagacccccagccttacctacaacggttaacctggtccccgaaccgaaggtgtagccatagtcgacgttccgaaacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaagttccgaaacctcttgctgagcgggctggcaaggc

SEQ ID NO: 406 - DNA, 495 bp, Artificial Sequence
  Oligonucleotide
gcctccctcgcgccatcagcgttacttacctcttgctggattccagcccctttttgcaagttcccagctgtccagccttgacttactcacctacaacagtgagccaacttccctctccaaaatatatggtgtttcgtcgaccgttacttacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaacgttacttacctcttgctgagcgggctggcaaggc

SEQ ID NO: 407 - DNA, 495 bp, Artificial Sequence
  Oligonucleotide
gcctccctcgcgccatcagtaggagacacctcttgctcctggaactccgaccttatgatacactatcccgaaagaagtcttttacatacccaagacagagagctgggttccactgccaaaaaacagtttttcattgtcgactaggagacacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaataggagacacctcttgctgagcgggctggcaaggc

SEQ ID NO: 408 - DNA, 495 bp, Artificial Sequence
  Oligonucleotide
gcctccctcgcgccatcaggacactctacctcttgagagaactctgccttcaagggacaatggccataccaccctgattctgcaacttacctaggatggagagtcgagtcccatcaccaaaatgctggggctgatgtcgacgacactctacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaagacactctacctcttgctgagcgggctggcaaggc

SEQ ID NO: 409 - DNA, 495 bp, Artificial Sequence
  Oligonucleotide
gcctccctcgcgccatcagttcggaacacctcttgatcattgcagtcaaacccaggcacccccgagtcaagagtggagcccccatacctgtcacagtgagcctggtcccgttcccaaagtggaggggtgaattatgtcgacttcggaacacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaattcggaacacctcttgctgagcgggctggcaaggc

SEQ ID NO: 410 - DNA, 495 bp, Artificial Sequence
  Oligonucleotide
gcctccctcgcgccatcagaagtaacgacctcttggggtcgtgcaggctgggctgctcaccctctctcccacctggagcccccttcttacctagcacggtgagccgtgtccctggcccgaagaactgctcattgtgtcgacaagtaacgacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaaaagtaacgacctcttgctgagcgggctggcaaggc

SEQ ID NO: 411 - DNA, 495 bp, Artificial Sequence
  Oligonucleotide
gcctccctcgcgccatcaggtctcctaacctcttgcctctgcccatcccgccctctcggagctctccggagccccaaccgcctccttacccagtacggtcagcctagagccttctccaaaaaacagctccccggtgtcgacgtctcctaacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaagtctcctaacctcttgctgagcgggctggcaaggc

SEQ ID NO: 412 - DNA, 495 bp, Artificial Sequence
  Oligonucleotide
gcctccctcgcgccatcaggtagacacacctcttggcgtcccggggcgccccctccccagttccggggcttcagcgggagcccccgcttaccgagcactgtcagccgggtgcctgggccaaaatactgcgtatctgtcgacgtagacacacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaagtagacacacctcttgctgagcgggctggcaaggc

SEQ ID NO: 413 - DNA, 495 bp, Artificial Sequence
  Oligonucleotide
gcctccctcgcgccatcagcactgtacacctcttgcgcacaaaaacccgagcgcagtctcgtccccggtcccccggcggccccagcttacccagcactgagagccgggtcccggcgccgaagtactgaatgttttgtcgaccactgtacacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaacactgtacacctcttgctgagcgggctggcaaggc

SEQ ID NO: 414 - DNA, 495 bp, Artificial Sequence
  Oligonucleotide
gcctccctcgcgccatcaggatgatccacctcttgccccgcaaaaaccagacccaagccgcccgcgcccgcgccccagcagcccgcgctcaccgagcaccaggagccgcgtgcctggcccgaagtactgggtctcgtcgacgatgatccacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaagatgatccacctcttgctgagcgggctggcaaggc

SEQ ID NO: 415 - DNA, 495 bp, Artificial Sequence
  Oligonucleotide
gcctccctcgcgccatcagcgccaataacctcttgccgccgccttccacctgaatcccgccgcccgggtggtcccgcgaaaactcacccagcacggtcagcctgctgccggccccgaaagtcaggacgttggcccgtcgaccgccaataacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaacgccaataacctcttgctgagcgggctggcaaggc

SEQ ID NO: 416 - DNA, 495 bp, Artificial Sequence
  Oligonucleotide
gcctccctcgcgccatcagtcaagcctacctcttgccaccctccgactccggggaccgaggggctggaaggtggggagacgcccgaatctcacctgtgaccgtgagcctggtgcccggcccgaagtactgctcgtgtcgactcaagcctacctcttgtcactgctggcacagagatacacggcggagtcctcctgctgtgtgcgctggatcttcagagtggagacggatccctcaggcctttctgcaaagaagcgatcactgggcagccccgatttgtctagttgagcttcattctggaaataagtcagaaactctggcccctgccccagggcctgttggtaccaaaaaagggatacatgacccgaaattggatcacacctgagagctacatcctgtcctctctttgcgactttgtacctaggggactgggagactccagcacctgtgtgatctgtggaatcaagcctacctcttgctgagcgggctggcaaggc

SEQ ID NO: 417 - DNA, 495 bp, Artificial Sequence
  Oligonucleotide
gcctccctcgcgccatcagagagtgtcctgattctctgtggacccacttttccctgtgacggatctgcaaaagaacctgaaaaatgtcttacctacaactgtgagtctggtgccttgtccaaagaaagcttcagtgtcgacagagtgtcctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagagagtgtcctgattctctgagcgggctggcaaggc

SEQ ID NO: 418 - DNA, 495 bp, Artificial Sequence
  Oligonucleotide
gcctccctcgcgccatcaggttccgaactgattctatttcccaggacagagtcctccctcatcgcacccctcctagagacccccagccttacctacaacggttaacctggtccccgaaccgaaggtgtagccatagtcgacgttccgaactgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggaggttccgaactgattctctgagcgggctggcaaggc

SEQ ID NO: 419 - DNA, 495 bp, Artificial Sequence
  Oligonucleotide
gcctccctcgcgccatcagcgttacttctgattctctggattccagcccctttttgcaagttcccagctgtccagccttgacttactcacctacaacagtgagccaacttccctctccaaaatatatggtgtttcgtcgaccgttacttctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagcgttacttctgattctctgagcgggctggcaaggc

SEQ ID NO: 420 - DNA, 495 bp, Artificial Sequence
  Oligonucleotide
gcctccctcgcgccatcagtaggagacctgattctctcctggaactccgaccttatgatacactatcccgaaagaagtcttttacatacccaagacagagagctgggttccactgccaaaaaacagtttttcattgtcgactaggagacctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagtaggagacctgattctctgagcgggctggcaaggc

SEQ ID NO: 421 - DNA, 495 bp, Artificial Sequence
  Oligonucleotide
gcctccctcgcgccatcaggacactctctgattctagagaactctgccttcaagggacaatggccataccaccctgattctgcaacttacctaggatggagagtcgagtcccatcaccaaaatgctggggctgatgtcgacgacactctctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggaggacactctctgattctctgagcgggctggcaaggc

SEQ ID NO: 422 - DNA, 495 bp, Artificial Sequence
  Oligonucleotide
gcctccctcgcgccatcagttcggaacctgattctatcattgcagtcaaacccaggcacccccgagtcaagagtggagcccccatacctgtcacagtgagcctggtcccgttcccaaagtggaggggtgaattatgtcgacttcggaacctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagttcggaacctgattctctgagcgggctggcaaggc

SEQ ID NO: 423 - DNA, 495 bp, Artificial Sequence
  Oligonucleotide
gcctccctcgcgccatcagaagtaacgctgattctgggtcgtgcaggctgggctgctcaccctctctcccacctggagcccccttcttacctagcacggtgagccgtgtccctggcccgaagaactgctcattgtgtcgacaagtaacgctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagaagtaacgctgattctctgagcgggctggcaaggc

SEQ ID NO: 424 - DNA, 495 bp, Artificial Sequence
  Oligonucleotide
gcctccctcgcgccatcaggtctcctactgattctcctctgcccatcccgccctctcggagctctccggagccccaaccgcctccttacccagtacggtcagcctagagccttctccaaaaaacagctccccggtgtcgacgtctcctactgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggaggtctcctactgattctctgagcgggctggcaaggc

SEQ ID NO: 425 - DNA, 495 bp, Artificial Sequence
  Oligonucleotide
gcctccctcgcgccatcaggtagacacctgattctgcgtcccggggcgccccctccccagttccggggcttcagcgggagcccccgcttaccgagcactgtcagccgggtgcctgggccaaaatactgcgtatctgtcgacgtagacacctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggaggtagacacctgattctctgagcgggctggcaaggc

SEQ ID NO: 426 - DNA, 495 bp, Artificial Sequence
  Oligonucleotide
gcctccctcgcgccatcagcactgtacctgattctcgcacaaaaacccgagcgcagtctcgtccccggtcccccggcggccccagcttacccagcactgagagccgggtcccggcgccgaagtactgaatgttttgtcgaccactgtacctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagcactgtacctgattctctgagcgggctggcaaggc

SEQ ID NO: 427 - DNA, 495 bp, Artificial Sequence
  Oligonucleotide
gcctccctcgcgccatcaggatgatccctgattctccccgcaaaaaccagacccaagccgcccgcgcccgcgccccagcagcccgcgctcaccgagcaccaggagccgcgtgcctggcccgaagtactgggtctcgtcgacgatgatccctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggaggatgatccctgattctctgagcgggctggcaaggc

SEQ ID NO: 428 - DNA, 495 bp, Artificial Sequence
  Oligonucleotide
gcctccctcgcgccatcagcgccaatactgattctccgccgccttccacctgaatcccgccgcccgggtggtcccgcgaaaactcacccagcacggtcagcctgctgccggccccgaaagtcaggacgttggcccgtcgaccgccaatactgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagcgccaatactgattctctgagcgggctggcaaggc

SEQ ID NO: 429 - DNA, 495 bp, Artificial Sequence
  Oligonucleotide
gcctccctcgcgccatcagtcaagcctctgattctccaccctccgactccggggaccgaggggctggaaggtggggagacgcccgaatctcacctgtgaccgtgagcctggtgcccggcccgaagtactgctcgtgtcgactcaagcctctgattcttcactgctggcacagagatacatggccgagtccccctgctctgtgcgctggatctccaaggtggagaaagatcccttaggcctctctgcagagaaccgatcactgagcagccttgatttttctagttgagcttcattctggaagtaagtcagaaactctgggccctgccccagggtctgtcggtaccaataaaggcggttgtgttcagaaattggatcacacctgaaagttacattctgtcccctctttgtgatcttgtgtctggggttctgggagactccagtatctgcgtgatctgtggagtcaagcctctgattctctgagcgggctggcaaggc

SEQ ID NO: 430 - DNA, 495 bp, Artificial Sequence
  Oligonucleotide
gcctccctcgcgccatcagagagtgtcggtcaactctgtggacccacttttccctgtgacggatctgcaaaagaacctgaaaaatgtcttacctacaactgtgagtctggtgccttgtccaaagaaagcttcagtgtcgacagagtgtcggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagagagtgtcggtcaactctgagcgggctggcaaggc

SEQ ID NO: 431 - DNA, 495 bp, Artificial Sequence
  Oligonucleotide
gcctccctcgcgccatcaggttccgaaggtcaactatttcccaggacagagtcctccctcatcgcacccctcctagagacccccagccttacctacaacggttaacctggtccccgaaccgaaggtgtagccatagtcgacgttccgaaggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcaggttccgaaggtcaactctgagcgggctggcaaggc

SEQ ID NO: 432 - DNA, 495 bp, Artificial Sequence
  Oligonucleotide
gcctccctcgcgccatcagcgttacttggtcaactctggattccagcccctttttgcaagttcccagctgtccagccttgacttactcacctacaacagtgagccaacttccctctccaaaatatatggtgtttcgtcgaccgttacttggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagcgttacttggtcaactctgagcgggctggcaaggc

SEQ ID NO: 433 - DNA, 495 bp, Artificial Sequence
  Oligonucleotide
gcctccctcgcgccatcagtaggagacggtcaactctcctggaactccgaccttatgatacactatcccgaaagaagtcttttacatacccaagacagagagctgggttccactgccaaaaaacagtttttcattgtcgactaggagacggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagtaggagacggtcaactctgagcgggctggcaaggc

SEQ ID NO: 434 - DNA, 495 bp, Artificial Sequence
  Oligonucleotide
gcctccctcgcgccatcaggacactctggtcaactagagaactctgccttcaagggacaatggccataccaccctgattctgcaacttacctaggatggagagtcgagtcccatcaccaaaatgctggggctgatgtcgacgacactctggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcaggacactctggtcaactctgagcgggctggcaaggc

SEQ ID NO: 435 - DNA, 495 bp, Artificial Sequence
  Oligonucleotide
gcctccctcgcgccatcagttcggaacggtcaactatcattgcagtcaaacccaggcacccccgagtcaagagtggagcccccatacctgtcacagtgagcctggtcccgttcccaaagtggaggggtgaattatgtcgacttcggaacggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagttcggaacggtcaactctgagcgggctggcaaggc

SEQ ID NO: 436 - DNA, 495 bp, Artificial Sequence
  Oligonucleotide
gcctccctcgcgccatcagaagtaacgggtcaactgggtcgtgcaggctgggctgctcaccctctctcccacctggagcccccttcttacctagcacggtgagccgtgtccctggcccgaagaactgctcattgtgtcgacaagtaacgggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagaagtaacgggtcaactctgagcgggctggcaaggc

SEQ ID NO: 437 - DNA, 495 bp, Artificial Sequence
  Oligonucleotide
gcctccctcgcgccatcaggtctcctaggtcaactcctctgcccatcccgccctctcggagctctccggagccccaaccgcctccttacccagtacggtcagcctagagccttctccaaaaaacagctccccggtgtcgacgtctcctaggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcaggtctcctaggtcaactctgagcgggctggcaaggc

SEQ ID NO: 438 - DNA, 495 bp, Artificial Sequence
  Oligonucleotide
gcctccctcgcgccatcaggtagacacggtcaactgcgtcccggggcgccccctccccagttccggggcttcagcgggagcccccgcttaccgagcactgtcagccgggtgcctgggccaaaatactgcgtatctgtcgacgtagacacggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcaggtagacacggtcaactctgagcgggctggcaaggc

SEQ ID NO: 439 - DNA, 495 bp, Artificial Sequence
  Oligonucleotide
gcctccctcgcgccatcagcactgtacggtcaactcgcacaaaaacccgagcgcagtctcgtccccggtcccccggcggccccagcttacccagcactgagagccgggtcccggcgccgaagtactgaatgttttgtcgaccactgtacggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagcactgtacggtcaactctgagcgggctggcaaggc

SEQ ID NO: 440 - DNA, 495 bp, Artificial Sequence
  Oligonucleotide
gcctccctcgcgccatcaggatgatccggtcaactccccgcaaaaaccagacccaagccgcccgcgcccgcgccccagcagcccgcgctcaccgagcaccaggagccgcgtgcctggcccgaagtactgggtctcgtcgacgatgatccggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcaggatgatccggtcaactctgagcgggctggcaaggc

SEQ ID NO: 441 - DNA, 495 bp, Artificial Sequence
  Oligonucleotide
gcctccctcgcgccatcagcgccaataggtcaactccgccgccttccacctgaatcccgccgcccgggtggtcccgcgaaaactcacccagcacggtcagcctgctgccggccccgaaagtcaggacgttggcccgtcgaccgccaataggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagcgccaataggtcaactctgagcgggctggcaaggc

SEQ ID NO: 442 - DNA, 495 bp, Artificial Sequence
  Oligonucleotide
gcctccctcgcgccatcagtcaagcctggtcaactccaccctccgactccggggaccgaggggctggaaggtggggagacgcccgaatctcacctgtgaccgtgagcctggtgcccggcccgaagtactgctcgtgtcgactcaagcctggtcaacttcactgccacagaggtacagaggtctggctggtgctagtagactccagggttgagggaaaatgcttgagtttgtttccagagacattgtacccttccttggcaccgcctttggtcatgctgccaatactacctgaataatggatcagcctcagcccctattcttggtcttattgataacagaacactgaataatggttcctaatctgagcaaatttcaggatgatctttttccctgtgtgtctgtgatatcttggtatctggctgatccctgcctccatgggggctgtgggagaggcaggcagtcaagcctggtcaactctgagcgggctggcaaggc

SEQ ID NO: 443 - DNA, 495 bp, Artificial Sequence
  Oligonucleotide
gcctccctcgcgccatcagagagtgtctacgtacgctgtggacccacttttccctgtgacggatctgcaaaagaacctgaaaaatgtcttacctacaactgtgagtctggtgccttgtccaaagaaagcttcagtgtcgacagagtgtctacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaaagagtgtctacgtacgctgagcgggctggcaaggc

SEQ ID NO: 444 - DNA, 495 bp, Artificial Sequence
  Oligonucleotide
gcctccctcgcgccatcaggttccgaatacgtacgatttcccaggacagagtcctccctcatcgcacccctcctagagacccccagccttacctacaacggttaacctggtccccgaaccgaaggtgtagccatagtcgacgttccgaatacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaagttccgaatacgtacgctgagcgggctggcaaggc

SEQ ID NO: 445 - DNA, 495 bp, Artificial Sequence
  Oligonucleotide
gcctccctcgcgccatcagcgttactttacgtacgctggattccagcccctttttgcaagttcccagctgtccagccttgacttactcacctacaacagtgagccaacttccctctccaaaatatatggtgtttcgtcgaccgttactttacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaacgttactttacgtacgctgagcgggctggcaaggc

SEQ ID NO: 446 - DNA, 495 bp, Artificial Sequence
  Oligonucleotide
gcctccctcgcgccatcagtaggagactacgtacgctcctggaactccgaccttatgatacactatcccgaaagaagtcttttacatacccaagacagagagctgggttccactgccaaaaaacagtttttcattgtcgactaggagactacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaataggagactacgtacgctgagcgggctggcaaggc

SEQ ID NO: 447 - DNA, 495 bp, Artificial Sequence
  Oligonucleotide
gcctccctcgcgccatcaggacactcttacgtacgagagaactctgccttcaagggacaatggccataccaccctgattctgcaacttacctaggatggagagtcgagtcccatcaccaaaatgctggggctgatgtcgacgacactcttacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaagacactcttacgtacgctgagcgggctggcaaggc

SEQ ID NO: 448 - DNA, 495 bp, Artificial Sequence
  Oligonucleotide
gcctccctcgcgccatcagttcggaactacgtacgatcattgcagtcaaacccaggcacccccgagtcaagagtggagcccccatacctgtcacagtgagcctggtcccgttcccaaagtggaggggtgaattatgtcgacttcggaactacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaattcggaactacgtacgctgagcgggctggcaaggc

SEQ ID NO: 449 - DNA, 495 bp, Artificial Sequence
  Oligonucleotide
gcctccctcgcgccatcagaagtaacgtacgtacggggtcgtgcaggctgggctgctcaccctctctcccacctggagcccccttcttacctagcacggtgagccgtgtccctggcccgaagaactgctcattgtgtcgacaagtaacgtacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaaaagtaacgtacgtacgctgagcgggctggcaaggc

SEQ ID NO: 450 - DNA, 495 bp, Artificial Sequence
  Oligonucleotide
gcctccctcgcgccatcaggtctcctatacgtacgcctctgcccatcccgccctctcggagctctccggagccccaaccgcctccttacccagtacggtcagcctagagccttctccaaaaaacagctccccggtgtcgacgtctcctatacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaagtctcctatacgtacgctgagcgggctggcaaggc

SEQ ID NO: 451 - DNA, 495 bp, Artificial Sequence
  Oligonucleotide
gcctccctcgcgccatcaggtagacactacgtacggcgtcccggggcgccccctccccagttccggggcttcagcgggagcccccgcttaccgagcactgtcagccgggtgcctgggccaaaatactgcgtatctgtcgacgtagacactacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaagtagacactacgtacgctgagcgggctggcaaggc

SEQ ID NO: 452 - DNA, 495 bp, Artificial Sequence
  Oligonucleotide
gcctccctcgcgccatcagcactgtactacgtacgcgcacaaaaacccgagcgcagtctcgtccccggtcccccggcggccccagcttacccagcactgagagccgggtcccggcgccgaagtactgaatgttttgtcgaccactgtactacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaacactgtactacgtacgctgagcgggctggcaaggc

SEQ ID NO: 453 - DNA, 495 bp, Artificial Sequence
  Oligonucleotide
gcctccctcgcgccatcaggatgatcctacgtacgccccgcaaaaaccagacccaagccgcccgcgcccgcgccccagcagcccgcgctcaccgagcaccaggagccgcgtgcctggcccgaagtactgggtctcgtcgacgatgatcctacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaagatgatcctacgtacgctgagcgggctggcaaggc

SEQ ID NO: 454 - DNA, 495 bp, Artificial Sequence
  Oligonucleotide
gcctccctcgcgccatcagcgccaatatacgtacgccgccgccttccacctgaatcccgccgcccgggtggtcccgcgaaaactcacccagcacggtcagcctgctgccggccccgaaagtcaggacgttggcccgtcgaccgccaatatacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaacgccaatatacgtacgctgagcgggctggcaaggc

SEQ ID NO: 455 - DNA, 495 bp, Artificial Sequence
  Oligonucleotide
gcctccctcgcgccatcagtcaagccttacgtacgccaccctccgactccggggaccgaggggctggaaggtggggagacgcccgaatctcacctgtgaccgtgagcctggtgcccggcccgaagtactgctcgtgtcgactcaagccttacgtacgtcactgccacagtggtacagataggtctggctggtgctggtggatgccaggattggggaaatgctcaagcttgtttcaagaaacacagtacccctctgtgacatcaactttggtcctgctgtgaccactgcctgaatagtggataagcttcagcccccgtcttgggtcctgtcgatatcagaacactgttcctaacctgagcacattccaggatcatctctttcttctgtacaatgtgatatcttggcatctgggtgatcccagcatcaatagagcctgctggagaggcagacagaaagtgaatcaagccttacgtacgctgagcgggctggcaaggc

SEQ ID NO: 456 - DNA, 495 bp, Artificial Sequence
  Oligonucleotide
gcctccctcgcgccatcagagagtgtcagtaccgactgtggacccacttttccctgtgacggatctgcaaaagaacctgaaaaatgtcttacctacaactgtgagtctggtgccttgtccaaagaaagcttcagtgtcgacagagtgtcagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagaagagtgtcagtaccgactgagcgggctggcaaggc

SEQ ID NO: 457 - DNA, 495 bp, Artificial Sequence
  Oligonucleotide
gcctccctcgcgccatcaggttccgaaagtaccgaatttcccaggacagagtcctccctcatcgcacccctcctagagacccccagccttacctacaacggttaacctggtccccgaaccgaaggtgtagccatagtcgacgttccgaaagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagagttccgaaagtaccgactgagcgggctggcaaggc

SEQ ID NO: 458 - DNA, 495 bp, Artificial Sequence
  Oligonucleotide
gcctccctcgcgccatcagcgttacttagtaccgactggattccagcccctttttgcaagttcccagctgtccagccttgacttactcacctacaacagtgagccaacttccctctccaaaatatatggtgtttcgtcgaccgttacttagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagacgttacttagtaccgactgagcgggctggcaaggc

SEQ ID NO: 459 - DNA, 495 bp, Artificial Sequence
  Oligonucleotide
gcctccctcgcgccatcagtaggagacagtaccgactcctggaactccgaccttatgatacactatcccgaaagaagtcttttacatacccaagacagagagctgggttccactgccaaaaaacagtttttcattgtcgactaggagacagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagataggagacagtaccgactgagcgggctggcaaggc

SEQ ID NO: 460 - DNA, 495 bp, Artificial Sequence
  Oligonucleotide
gcctccctcgcgccatcaggacactctagtaccgaagagaactctgccttcaagggacaatggccataccaccctgattctgcaacttacctaggatggagagtcgagtcccatcaccaaaatgctggggctgatgtcgacgacactctagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagagacactctagtaccgactgagcgggctggcaaggc

SEQ ID NO: 461 - DNA, 495 bp, Artificial Sequence
  Oligonucleotide
gcctccctcgcgccatcagttcggaacagtaccgaatcattgcagtcaaacccaggcacccccgagtcaagagtggagcccccatacctgtcacagtgagcctggtcccgttcccaaagtggaggggtgaattatgtcgacttcggaacagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagattcggaacagtaccgactgagcgggctggcaaggc

SEQ ID NO: 462 - DNA, 495 bp, Artificial Sequence
  Oligonucleotide
gcctccctcgcgccatcagaagtaacgagtaccgagggtcgtgcaggctgggctgctcaccctctctcccacctggagcccccttcttacctagcacggtgagccgtgtccctggcccgaagaactgctcattgtgtcgacaagtaacgagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagaaagtaacgagtaccgactgagcgggctggcaaggc

SEQ ID NO: 463 - DNA, 495 bp, Artificial Sequence
  Oligonucleotide
gcctccctcgcgccatcaggtctcctaagtaccgacctctgcccatcccgccctctcggagctctccggagccccaaccgcctccttacccagtacggtcagcctagagccttctccaaaaaacagctccccggtgtcgacgtctcctaagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagagtctcctaagtaccgactgagcgggctggcaaggc

SEQ ID NO: 464 - DNA, 495 bp, Artificial Sequence
  Oligonucleotide
gcctccctcgcgccatcaggtagacacagtaccgagcgtcccggggcgccccctccccagttccggggcttcagcgggagcccccgcttaccgagcactgtcagccgggtgcctgggccaaaatactgcgtatctgtcgacgtagacacagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagagtagacacagtaccgactgagcgggctggcaaggc

SEQ ID NO: 465 - DNA, 495 bp, Artificial Sequence
  Oligonucleotide
gcctccctcgcgccatcagcactgtacagtaccgacgcacaaaaacccgagcgcagtctcgtccccggtcccccggcggccccagcttacccagcactgagagccgggtcccggcgccgaagtactgaatgttttgtcgaccactgtacagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagacactgtacagtaccgactgagcgggctggcaaggc

SEQ ID NO: 466 - DNA, 495 bp, Artificial Sequence
  Oligonucleotide
gcctccctcgcgccatcaggatgatccagtaccgaccccgcaaaaaccagacccaagccgcccgcgcccgcgccccagcagcccgcgctcaccgagcaccaggagccgcgtgcctggcccgaagtactgggtctcgtcgacgatgatccagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagagatgatccagtaccgactgagcgggctggcaaggc

SEQ ID NO: 467 - DNA, 495 bp, Artificial Sequence
  Oligonucleotide
gcctccctcgcgccatcagcgccaataagtaccgaccgccgccttccacctgaatcccgccgcccgggtggtcccgcgaaaactcacccagcacggtcagcctgctgccggccccgaaagtcaggacgttggcccgtcgaccgccaataagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagacgccaataagtaccgactgagcgggctggcaaggc

SEQ ID NO: 468 - DNA, 495 bp, Artificial Sequence
  Oligonucleotide
gcctccctcgcgccatcagtcaagcctagtaccgaccaccctccgactccggggaccgaggggctggaaggtggggagacgcccgaatctcacctgtgaccgtgagcctggtgcccggcccgaagtactgctcgtgtcgactcaagcctagtaccgatcatgctggcacagaaatacaaagctgagtcccccagctccagagagctcaggtttagttcagagtgcaagtcagggaactgttgtgcggagaatcgttcaagaatgtttccttttgctctctcttctccattataatactgaatgaggaactggaggccctggtccaggctctgttggtaccagtacacagagaggtctccagacctaggggagcatctcagcgtcactcgctgtccagttgctgtgatcaggtgctttggggtttgtgtgactccagaatccactgggcctgtgtgtcagatcaagcctagtaccgactgagcgggctggcaaggc

SEQ ID NO: 469 - DNA, 495 bp, Artificial Sequence
  Oligonucleotide
gcctccctcgcgccatcagagagtgtcatccatggctgtggacccacttttccctgtgacggatctgcaaaagaacctgaaaaatgtcttacctacaactgtgagtctggtgccttgtccaaagaaagcttcagtgtcgacagagtgtcatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagagagtgtcatccatggctgagcgggctggcaaggc

SEQ ID NO: 470 - DNA, 495 bp, Artificial Sequence
  Oligonucleotide
gcctccctcgcgccatcaggttccgaaatccatggatttcccaggacagagtcctccctcatcgcacccctcctagagacccccagccttacctacaacggttaacctggtccccgaaccgaaggtgtagccatagtcgacgttccgaaatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagaggttccgaaatccatggctgagcgggctggcaaggc

SEQ ID NO: 471 - DNA, 495 bp, Artificial Sequence
  Oligonucleotide
gcctccctcgcgccatcagcgttacttatccatggctggattccagcccctttttgcaagttcccagctgtccagccttgacttactcacctacaacagtgagccaacttccctctccaaaatatatggtgtttcgtcgaccgttacttatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagcgttacttatccatggctgagcgggctggcaaggc

SEQ ID NO: 472 - DNA, 495 bp, Artificial Sequence
  Oligonucleotide
gcctccctcgcgccatcagtaggagacatccatggctcctggaactccgaccttatgatacactatcccgaaagaagtcttttacatacccaagacagagagctgggttccactgccaaaaaacagtttttcattgtcgactaggagacatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagtaggagacatccatggctgagcgggctggcaaggc

SEQ ID NO: 473 - DNA, 495 bp, Artificial Sequence
  Oligonucleotide
gcctccctcgcgccatcaggacactctatccatggagagaactctgccttcaagggacaatggccataccaccctgattctgcaacttacctaggatggagagtcgagtcccatcaccaaaatgctggggctgatgtcgacgacactctatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagaggacactctatccatggctgagcgggctggcaaggc

SEQ ID NO: 474 - DNA, 495 bp, Artificial Sequence
  Oligonucleotide
gcctccctcgcgccatcagttcggaacatccatggatcattgcagtcaaacccaggcacccccgagtcaagagtggagcccccatacctgtcacagtgagcctggtcccgttcccaaagtggaggggtgaattatgtcgacttcggaacatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagttcggaacatccatggctgagcgggctggcaaggc

SEQ ID NO: 475 - DNA, 495 bp, Artificial Sequence
  Oligonucleotide
gcctccctcgcgccatcagaagtaacgatccatgggggtcgtgcaggctgggctgctcaccctctctcccacctggagcccccttcttacctagcacggtgagccgtgtccctggcccgaagaactgctcattgtgtcgacaagtaacgatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagaagtaacgatccatggctgagcgggctggcaaggc

SEQ ID NO: 476 - DNA, 495 bp, Artificial Sequence
  Oligonucleotide
gcctccctcgcgccatcaggtctcctaatccatggcctctgcccatcccgccctctcggagctctccggagccccaaccgcctccttacccagtacggtcagcctagagccttctccaaaaaacagctccccggtgtcgacgtctcctaatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagaggtctcctaatccatggctgagcgggctggcaaggc

SEQ ID NO: 477 - DNA, 495 bp, Artificial Sequence
  Oligonucleotide
gcctccctcgcgccatcaggtagacacatccatgggcgtcccggggcgccccctccccagttccggggcttcagcgggagcccccgcttaccgagcactgtcagccgggtgcctgggccaaaatactgcgtatctgtcgacgtagacacatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagaggtagacacatccatggctgagcgggctggcaaggc

SEQ ID NO: 478 - DNA, 495 bp, Artificial Sequence
  Oligonucleotide
gcctccctcgcgccatcagcactgtacatccatggcgcacaaaaacccgagcgcagtctcgtccccggtcccccggcggccccagcttacccagcactgagagccgggtcccggcgccgaagtactgaatgttttgtcgaccactgtacatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagcactgtacatccatggctgagcgggctggcaaggc

SEQ ID NO: 479 - DNA, 495 bp, Artificial Sequence
  Oligonucleotide
gcctccctcgcgccatcaggatgatccatccatggccccgcaaaaaccagacccaagccgcccgcgcccgcgccccagcagcccgcgctcaccgagcaccaggagccgcgtgcctggcccgaagtactgggtctcgtcgacgatgatccatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagaggatgatccatccatggctgagcgggctggcaaggc

SEQ ID NO: 480 - DNA, 495 bp, Artificial Sequence
  Oligonucleotide
gcctccctcgcgccatcagcgccaataatccatggccgccgccttccacctgaatcccgccgcccgggtggtcccgcgaaaactcacccagcacggtcagcctgctgccggccccgaaagtcaggacgttggcccgtcgaccgccaataatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagcgccaataatccatggctgagcgggctggcaaggc

SEQ ID NO: 481 - DNA, 495 bp, Artificial Sequence
  Oligonucleotide
gcctccctcgcgccatcagtcaagcctatccatggccaccctccgactccggggaccgaggggctggaaggtggggagacgcccgaatctcacctgtgaccgtgagcctggtgcccggcccgaagtactgctcgtgtcgactcaagcctatccatggtcactgctggcgcagaaatatacagatgtctgggaggaggcagcagactccagagtgagggggaggtcctctgtgtttgatctagagacactgtagccatctgagacttctcctttgttagtgtcttgaacaccatatgagtaatggatcagcctcagcccatgtcccaggtcttgtcgataccagaacatattgttgtggttccaagtctggtgacacgccaaggtcacctgccttcctgtctctgtgatcttgtgtcttgggctctgggtgatttcagcatccctgtgtcctgtaatagagtcaagcctatccatggctgagcgggctggcaaggc

SEQ ID NO: 482 - DNA, 495 bp, Artificial Sequence
  Oligonucleotide
gcctccctcgcgccatcagagagtgtcgtagcagtctgtggacccacttttccctgtgacggatctgcaaaagaacctgaaaaatgtcttacctacaactgtgagtctggtgccttgtccaaagaaagcttcagtgtcgacagagtgtcgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagagagtgtcgtagcagtctgagcgggctggcaaggc

SEQ ID NO: 483 - DNA, 495 bp, Artificial Sequence
  Oligonucleotide
gcctccctcgcgccatcaggttccgaagtagcagtatttcccaggacagagtcctccctcatcgcacccctcctagagacccccagccttacctacaacggttaacctggtccccgaaccgaaggtgtagccatagtcgacgttccgaagtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagaggttccgaagtagcagtctgagcgggctggcaaggc

SEQ ID NO: 484 - DNA, 495 bp, Artificial Sequence
  Oligonucleotide
gcctccctcgcgccatcagcgttacttgtagcagtctggattccagcccctttttgcaagttcccagctgtccagccttgacttactcacctacaacagtgagccaacttccctctccaaaatatatggtgtttcgtcgaccgttacttgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagcgttacttgtagcagtctgagcgggctggcaaggc

SEQ ID NO: 485 - DNA, 495 bp, Artificial Sequence
  Oligonucleotide
gcctccctcgcgccatcagtaggagacgtagcagtctcctggaactccgaccttatgatacactatcccgaaagaagtcttttacatacccaagacagagagctgggttccactgccaaaaaacagtttttcattgtcgactaggagacgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagtaggagacgtagcagtctgagcgggctggcaaggc

SEQ ID NO: 486 - DNA, 495 bp, Artificial Sequence
  Oligonucleotide
gcctccctcgcgccatcaggacactctgtagcagtagagaactctgccttcaagggacaatggccataccaccctgattctgcaacttacctaggatggagagtcgagtcccatcaccaaaatgctggggctgatgtcgacgacactctgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagaggacactctgtagcagtctgagcgggctggcaaggc

SEQ ID NO: 487 - DNA, 495 bp, Artificial Sequence
  Oligonucleotide
gcctccctcgcgccatcagttcggaacgtagcagtatcattgcagtcaaacccaggcacccccgagtcaagagtggagcccccatacctgtcacagtgagcctggtcccgttcccaaagtggaggggtgaattatgtcgacttcggaacgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagttcggaacgtagcagtctgagcgggctggcaaggc

SEQ ID NO: 488 - DNA, 495 bp, Artificial Sequence
  Oligonucleotide
gcctccctcgcgccatcagaagtaacggtagcagtgggtcgtgcaggctgggctgctcaccctctctcccacctggagcccccttcttacctagcacggtgagccgtgtccctggcccgaagaactgctcattgtgtcgacaagtaacggtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagaagtaacggtagcagtctgagcgggctggcaaggc

SEQ ID NO: 489 - DNA, 495 bp, Artificial Sequence
  Oligonucleotide
gcctccctcgcgccatcaggtctcctagtagcagtcctctgcccatcccgccctctcggagctctccggagccccaaccgcctccttacccagtacggtcagcctagagccttctccaaaaaacagctccccggtgtcgacgtctcctagtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagaggtctcctagtagcagtctgagcgggctggcaaggc

SEQ ID NO: 490 - DNA, 495 bp, Artificial Sequence
  Oligonucleotide
gcctccctcgcgccatcaggtagacacgtagcagtgcgtcccggggcgccccctccccagttccggggcttcagcgggagcccccgcttaccgagcactgtcagccgggtgcctgggccaaaatactgcgtatctgtcgacgtagacacgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagaggtagacacgtagcagtctgagcgggctggcaaggc

SEQ ID NO: 491 - DNA, 495 bp, Artificial Sequence
  Oligonucleotide
gcctccctcgcgccatcagcactgtacgtagcagtcgcacaaaaacccgagcgcagtctcgtccccggtcccccggcggccccagcttacccagcactgagagccgggtcccggcgccgaagtactgaatgttttgtcgaccactgtacgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagcactgtacgtagcagtctgagcgggctggcaaggc

SEQ ID NO: 492 - DNA, 495 bp, Artificial Sequence
  Oligonucleotide
gcctccctcgcgccatcaggatgatccgtagcagtccccgcaaaaaccagacccaagccgcccgcgcccgcgccccagcagcccgcgctcaccgagcaccaggagccgcgtgcctggcccgaagtactgggtctcgtcgacgatgatccgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagaggatgatccgtagcagtctgagcgggctggcaaggc

SEQ ID NO: 493 - DNA, 495 bp, Artificial Sequence
  Oligonucleotide
gcctccctcgcgccatcagcgccaatagtagcagtccgccgccttccacctgaatcccgccgcccgggtggtcccgcgaaaactcacccagcacggtcagcctgctgccggccccgaaagtcaggacgttggcccgtcgaccgccaatagtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagcgccaatagtagcagtctgagcgggctggcaaggc

SEQ ID NO: 494 - DNA, 495 bp, Artificial Sequence
  Oligonucleotide
gcctccctcgcgccatcagtcaagcctgtagcagtccaccctccgactccggggaccgaggggctggaaggtggggagacgcccgaatctcacctgtgaccgtgagcctggtgcccggcccgaagtactgctcgtgtcgactcaagcctgtagcagttcactgctggcgcagaaatacacagatgtctgggagcgggtagctgactccagagtgagggggaaattctctgtcttggatctggagacaacatagccatcggggacttctcctttatctgtaatatcagcagctgctgagtaatagatcagcctcagcccatgtcccaggtcttgtcgataccagaacatatagctgtggctccaagtctggtgacacatcaaggtcacctgccttcctgtctctgtgatcttgtatcttgggctctgggtgattccagcatccctgtgtcctgtaatagagtcaagcctgtagcagtctgagcgggctggcaaggc

SEQ ID NO: 495 - DNA, 495 bp, Artificial Sequence
  Oligonucleotide
gcctccctcgcgccatcagagagtgtcatcttcgtctgtggacccacttttccctgtgacggatctgcaaaagaacctgaaaaatgtcttacctacaactgtgagtctggtgccttgtccaaagaaagcttcagtgtcgacagagtgtcatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaaagagtgtcatcttcgtctgagcgggctggcaaggc

SEQ ID NO: 496 - DNA, 495 bp, Artificial Sequence
  Oligonucleotide
gcctccctcgcgccatcaggttccgaaatcttcgtatttcccaggacagagtcctccctcatcgcacccctcctagagacccccagccttacctacaacggttaacctggtccccgaaccgaaggtgtagccatagtcgacgttccgaaatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaagttccgaaatcttcgtctgagcgggctggcaaggc

SEQ ID NO: 497 - DNA, 495 bp, Artificial Sequence
  Oligonucleotide
gcctccctcgcgccatcagcgttacttatcttcgtctggattccagcccctttttgcaagttcccagctgtccagccttgacttactcacctacaacagtgagccaacttccctctccaaaatatatggtgtttcgtcgaccgttacttatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaacgttacttatcttcgtctgagcgggctggcaaggc

SEQ ID NO: 498 - DNA, 495 bp, Artificial Sequence
  Oligonucleotide
gcctccctcgcgccatcagtaggagacatcttcgtctcctggaactccgaccttatgatacactatcccgaaagaagtcttttacatacccaagacagagagctgggttccactgccaaaaaacagtttttcattgtcgactaggagacatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaataggagacatcttcgtctgagcgggctggcaaggc

SEQ ID NO: 499 - DNA, 495 bp, Artificial Sequence
  Oligonucleotide
gcctccctcgcgccatcaggacactctatcttcgtagagaactctgccttcaagggacaatggccataccaccctgattctgcaacttacctaggatggagagtcgagtcccatcaccaaaatgctggggctgatgtcgacgacactctatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaagacactctatcttcgtctgagcgggctggcaaggc

SEQ ID NO: 500 - DNA, 495 bp, Artificial Sequence
  Oligonucleotide
gcctccctcgcgccatcagttcggaacatcttcgtatcattgcagtcaaacccaggcacccccgagtcaagagtggagcccccatacctgtcacagtgagcctggtcccgttcccaaagtggaggggtgaattatgtcgacttcggaacatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaattcggaacatcttcgtctgagcgggctggcaaggc

SEQ ID NO: 501 - DNA, 495 bp, Artificial Sequence
  Oligonucleotide
gcctccctcgcgccatcagaagtaacgatcttcgtgggtcgtgcaggctgggctgctcaccctctctcccacctggagcccccttcttacctagcacggtgagccgtgtccctggcccgaagaactgctcattgtgtcgacaagtaacgatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaaaagtaacgatcttcgtctgagcgggctggcaaggc

SEQ ID NO: 502 - DNA, 495 bp, Artificial Sequence
  Oligonucleotide
gcctccctcgcgccatcaggtctcctaatcttcgtcctctgcccatcccgccctctcggagctctccggagccccaaccgcctccttacccagtacggtcagcctagagccttctccaaaaaacagctccccggtgtcgacgtctcctaatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaagtctcctaatcttcgtctgagcgggctggcaaggc

SEQ ID NO: 503 - DNA, 495 bp, Artificial Sequence
  Oligonucleotide
gcctccctcgcgccatcaggtagacacatcttcgtgcgtcccggggcgccccctccccagttccggggcttcagcgggagcccccgcttaccgagcactgtcagccgggtgcctgggccaaaatactgcgtatctgtcgacgtagacacatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaagtagacacatcttcgtctgagcgggctggcaaggc

SEQ ID NO: 504 - DNA, 495 bp, Artificial Sequence
  Oligonucleotide
gcctccctcgcgccatcagcactgtacatcttcgtcgcacaaaaacccgagcgcagtctcgtccccggtcccccggcggccccagcttacccagcactgagagccgggtcccggcgccgaagtactgaatgttttgtcgaccactgtacatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaacactgtacatcttcgtctgagcgggctggcaaggc

SEQ ID NO: 505 - DNA, 495 bp, Artificial Sequence
  Oligonucleotide
gcctccctcgcgccatcaggatgatccatcttcgtccccgcaaaaaccagacccaagccgcccgcgcccgcgccccagcagcccgcgctcaccgagcaccaggagccgcgtgcctggcccgaagtactgggtctcgtcgacgatgatccatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaagatgatccatcttcgtctgagcgggctggcaaggc

SEQ ID NO: 506 - DNA, 495 bp, Artificial Sequence
  Oligonucleotide
gcctccctcgcgccatcagcgccaataatcttcgtccgccgccttccacctgaatcccgccgcccgggtggtcccgcgaaaactcacccagcacggtcagcctgctgccggccccgaaagtcaggacgttggcccgtcgaccgccaataatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaacgccaataatcttcgtctgagcgggctggcaaggc

SEQ ID NO: 507 - DNA, 495 bp, Artificial Sequence
  Oligonucleotide
gcctccctcgcgccatcagtcaagcctatcttcgtccaccctccgactccggggaccgaggggctggaaggtggggagacgcccgaatctcacctgtgaccgtgagcctggtgcccggcccgaagtactgctcgtgtcgactcaagcctatcttcgttcactgatggcacagaagtacacagatgtctgggagctggtagcggactccagagtgaggaggaaatcctctgtctttgatctagagacactatagccatctgagacttctcctttgtcagtatctttaacaccatatgagtaatggatcagcctcagcccatgccccgggtcttgtcgataccagtacatatagcggtggttctcagtctggtgacatctcagagtcactggtgttcctgtctctgtgaccttgtgtcttgggctctgggtgattccagcatccatgtgtcctgtaatagaatcaagcctatcttcgtctgagcgggctggcaaggc

SEQ ID NO: 508 - DNA, 495 bp, Artificial Sequence
  Oligonucleotide
gcctccctcgcgccatcagagagtgtctccacagtctgtggacccacttttccctgtgacggatctgcaaaagaacctgaaaaatgtcttacctacaactgtgagtctggtgccttgtccaaagaaagcttcagtgtcgacagagtgtctccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggagagtgtctccacagtctgagcgggctggcaaggc

SEQ ID NO: 509 - DNA, 495 bp, Artificial Sequence
  Oligonucleotide
gcctccctcgcgccatcaggttccgaatccacagtatttcccaggacagagtcctccctcatcgcacccctcctagagacccccagccttacctacaacggttaacctggtccccgaaccgaaggtgtagccatagtcgacgttccgaatccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttggggttccgaatccacagtctgagcgggctggcaaggc

SEQ ID NO: 510 - DNA, 495 bp, Artificial Sequence
  Oligonucleotide
gcctccctcgcgccatcagcgttactttccacagtctggattccagcccctttttgcaagttcccagctgtccagccttgacttactcacctacaacagtgagccaacttccctctccaaaatatatggtgtttcgtcgaccgttactttccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggcgttactttccacagtctgagcgggctggcaaggc

SEQ ID NO: 511 - DNA, 495 bp, Artificial Sequence
  Oligonucleotide
gcctccctcgcgccatcagtaggagactccacagtctcctggaactccgaccttatgatacactatcccgaaagaagtcttttacatacccaagacagagagctgggttccactgccaaaaaacagtttttcattgtcgactaggagactccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggtaggagactccacagtctgagcgggctggcaaggc

SEQ ID NO: 512 - DNA, 495 bp, Artificial Sequence
  Oligonucleotide
gcctccctcgcgccatcaggacactcttccacagtagagaactctgccttcaagggacaatggccataccaccctgattctgcaacttacctaggatggagagtcgagtcccatcaccaaaatgctggggctgatgtcgacgacactcttccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttggggacactcttccacagtctgagcgggctggcaaggc

SEQ ID NO: 513 - DNA, 495 bp, Artificial Sequence
  Oligonucleotide
gcctccctcgcgccatcagttcggaactccacagtatcattgcagtcaaacccaggcacccccgagtcaagagtggagcccccatacctgtcacagtgagcctggtcccgttcccaaagtggaggggtgaattatgtcgacttcggaactccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggttcggaactccacagtctgagcgggctggcaaggc

SEQ ID NO: 514 - DNA, 495 bp, Artificial Sequence
  Oligonucleotide
gcctccctcgcgccatcagaagtaacgtccacagtgggtcgtgcaggctgggctgctcaccctctctcccacctggagcccccttcttacctagcacggtgagccgtgtccctggcccgaagaactgctcattgtgtcgacaagtaacgtccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggaagtaacgtccacagtctgagcgggctggcaaggc

SEQ ID NO: 515 - DNA, 495 bp, Artificial Sequence
  Oligonucleotide
gcctccctcgcgccatcaggtctcctatccacagtcctctgcccatcccgccctctcggagctctccggagccccaaccgcctccttacccagtacggtcagcctagagccttctccaaaaaacagctccccggtgtcgacgtctcctatccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttggggtctcctatccacagtctgagcgggctggcaaggc

SEQ ID NO: 516 - DNA, 495 bp, Artificial Sequence
  Oligonucleotide
gcctccctcgcgccatcaggtagacactccacagtgcgtcccggggcgccccctccccagttccggggcttcagcgggagcccccgcttaccgagcactgtcagccgggtgcctgggccaaaatactgcgtatctgtcgacgtagacactccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttggggtagacactccacagtctgagcgggctggcaaggc

SEQ ID NO: 517 - DNA, 495 bp, Artificial Sequence
  Oligonucleotide
gcctccctcgcgccatcagcactgtactccacagtcgcacaaaaacccgagcgcagtctcgtccccggtcccccggcggccccagcttacccagcactgagagccgggtcccggcgccgaagtactgaatgttttgtcgaccactgtactccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggcactgtactccacagtctgagcgggctggcaaggc

SEQ ID NO: 518 - DNA, 495 bp, Artificial Sequence
  Oligonucleotide
gcctccctcgcgccatcaggatgatcctccacagtccccgcaaaaaccagacccaagccgcccgcgcccgcgccccagcagcccgcgctcaccgagcaccaggagccgcgtgcctggcccgaagtactgggtctcgtcgacgatgatcctccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttggggatgatcctccacagtctgagcgggctggcaaggc

SEQ ID NO: 519 - DNA, 495 bp, Artificial Sequence
  Oligonucleotide
gcctccctcgcgccatcagcgccaatatccacagtccgccgccttccacctgaatcccgccgcccgggtggtcccgcgaaaactcacccagcacggtcagcctgctgccggccccgaaagtcaggacgttggcccgtcgaccgccaatatccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggcgccaatatccacagtctgagcgggctggcaaggc

SEQ ID NO: 520 - DNA, 495 bp, Artificial Sequence
  Oligonucleotide
gcctccctcgcgccatcagtcaagccttccacagtccaccctccgactccggggaccgaggggctggaaggtggggagacgcccgaatctcacctgtgaccgtgagcctggtgcccggcccgaagtactgctcgtgtcgactcaagccttccacagttcactgctggcacagagatacatggccgagtccccaagctctgcaggctggatcttgagagtggagtctactcctttgagcctctctgcagaaaatcgatccttaggcaactgtgaatcatctactacactctcatcctgaaattgaaccagaagctccgggccctgtcccaggatctgccggtaccagtaaagggtagcatggccagaaataggatcacaccaaaaagccacagcctggcttttctctgtaatcttatatctgggggactgggcaacttcagcttctgagagttctgttgggtcaagccttccacagtctgagcgggctggcaaggc

SEQ ID NO: 521 - DNA, 495 bp, Artificial Sequence
  Oligonucleotide
gcctccctcgcgccatcagagagtgtcatgacaccctgtggacccacttttccctgtgacggatctgcaaaagaacctgaaaaatgtcttacctacaactgtgagtctggtgccttgtccaaagaaagcttcagtgtcgacagagtgtcatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagagagtgtcatgacaccctgagcgggctggcaaggc

SEQ ID NO: 522 - DNA, 495 bp, Artificial Sequence
  Oligonucleotide
gcctccctcgcgccatcaggttccgaaatgacaccatttcccaggacagagtcctccctcatcgcacccctcctagagacccccagccttacctacaacggttaacctggtccccgaaccgaaggtgtagccatagtcgacgttccgaaatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaaggttccgaaatgacaccctgagcgggctggcaaggc

SEQ ID NO: 523 - DNA, 495 bp, Artificial Sequence
  Oligonucleotide
gcctccctcgcgccatcagcgttacttatgacaccctggattccagcccctttttgcaagttcccagctgtccagccttgacttactcacctacaacagtgagccaacttccctctccaaaatatatggtgtttcgtcgaccgttacttatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagcgttacttatgacaccctgagcgggctggcaaggc

SEQ ID NO: 524 - DNA, 495 bp, Artificial Sequence
  Oligonucleotide
gcctccctcgcgccatcagtaggagacatgacaccctcctggaactccgaccttatgatacactatcccgaaagaagtcttttacatacccaagacagagagctgggttccactgccaaaaaacagtttttcattgtcgactaggagacatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagtaggagacatgacaccctgagcgggctggcaaggc

SEQ ID NO: 525 - DNA, 495 bp, Artificial Sequence
  Oligonucleotide
gcctccctcgcgccatcaggacactctatgacaccagagaactctgccttcaagggacaatggccataccaccctgattctgcaacttacctaggatggagagtcgagtcccatcaccaaaatgctggggctgatgtcgacgacactctatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaaggacactctatgacaccctgagcgggctggcaaggc

SEQ ID NO: 526 - DNA, 495 bp, Artificial Sequence
  Oligonucleotide
gcctccctcgcgccatcagttcggaacatgacaccatcattgcagtcaaacccaggcacccccgagtcaagagtggagcccccatacctgtcacagtgagcctggtcccgttcccaaagtggaggggtgaattatgtcgacttcggaacatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagttcggaacatgacaccctgagcgggctggcaaggc

SEQ ID NO: 527 - DNA, 495 bp, Artificial Sequence
  Oligonucleotide
gcctccctcgcgccatcagaagtaacgatgacaccgggtcgtgcaggctgggctgctcaccctctctcccacctggagcccccttcttacctagcacggtgagccgtgtccctggcccgaagaactgctcattgtgtcgacaagtaacgatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagaagtaacgatgacaccctgagcgggctggcaaggc

SEQ ID NO: 528 - DNA, 495 bp, Artificial Sequence
  Oligonucleotide
gcctccctcgcgccatcaggtctcctaatgacacccctctgcccatcccgccctctcggagctctccggagccccaaccgcctccttacccagtacggtcagcctagagccttctccaaaaaacagctccccggtgtcgacgtctcctaatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaaggtctcctaatgacaccctgagcgggctggcaaggc

SEQ ID NO: 529 - DNA, 495 bp, Artificial Sequence
  Oligonucleotide
gcctccctcgcgccatcaggtagacacatgacaccgcgtcccggggcgccccctccccagttccggggcttcagcgggagcccccgcttaccgagcactgtcagccgggtgcctgggccaaaatactgcgtatctgtcgacgtagacacatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaaggtagacacatgacaccctgagcgggctggcaaggc

SEQ ID NO: 530 - DNA, 495 bp, Artificial Sequence
  Oligonucleotide
gcctccctcgcgccatcagcactgtacatgacacccgcacaaaaacccgagcgcagtctcgtccccggtcccccggcggccccagcttacccagcactgagagccgggtcccggcgccgaagtactgaatgttttgtcgaccactgtacatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagcactgtacatgacaccctgagcgggctggcaaggc

SEQ ID NO: 531 - DNA, 495 bp, Artificial Sequence
  Oligonucleotide
gcctccctcgcgccatcaggatgatccatgacaccccccgcaaaaaccagacccaagccgcccgcgcccgcgccccagcagcccgcgctcaccgagcaccaggagccgcgtgcctggcccgaagtactgggtctcgtcgacgatgatccatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaaggatgatccatgacaccctgagcgggctggcaaggc

SEQ ID NO: 532 - DNA, 495 bp, Artificial Sequence
  Oligonucleotide
gcctccctcgcgccatcagcgccaataatgacaccccgccgccttccacctgaatcccgccgcccgggtggtcccgcgaaaactcacccagcacggtcagcctgctgccggccccgaaagtcaggacgttggcccgtcgaccgccaataatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagcgccaataatgacaccctgagcgggctggcaaggc

SEQ ID NO: 533 - DNA, 495 bp, Artificial Sequence
  Oligonucleotide
gcctccctcgcgccatcagtcaagcctatgacaccccaccctccgactccggggaccgaggggctggaaggtggggagacgcccgaatctcacctgtgaccgtgagcctggtgcccggcccgaagtactgctcgtgtcgactcaagcctatgacacctcactgctggcacagagatacacggccgagtcctcaagctttgcaggctggatcttgagagtggagtctactcctttgagcctctctgcagaaaatcgatccttaggcaactgtgaatcatccactacaccgttattctgaaactgaatcagaagctttgggccctgtcccaggatctgctggtaccagtaaagggtagcatggccagatataggattgcaccaaaaagccacactctgccttttctctataatcttatatctgggagactgggcaactccagcttctgtgagttctgagaagtcaagcctatgacaccctgagcgggctggcaaggc

SEQ ID NO: 534 - DNA, 495 bp, Artificial Sequence
  Oligonucleotide
gcctccctcgcgccatcagagagtgtccttcacgactgtggacccacttttccctgtgacggatctgcaaaagaacctgaaaaatgtcttacctacaactgtgagtctggtgccttgtccaaagaaagcttcagtgtcgacagagtgtccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggagagtgtccttcacgactgagcgggctggcaaggc

SEQ ID NO: 535 - DNA, 495 bp, Artificial Sequence
  Oligonucleotide
gcctccctcgcgccatcaggttccgaacttcacgaatttcccaggacagagtcctccctcatcgcacccctcctagagacccccagccttacctacaacggttaacctggtccccgaaccgaaggtgtagccatagtcgacgttccgaacttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtgggggttccgaacttcacgactgagcgggctggcaaggc

SEQ ID NO: 536 - DNA, 495 bp, Artificial Sequence
  Oligonucleotide
gcctccctcgcgccatcagcgttacttcttcacgactggattccagcccctttttgcaagttcccagctgtccagccttgacttactcacctacaacagtgagccaacttccctctccaaaatatatggtgtttcgtcgaccgttacttcttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggcgttacttcttcacgactgagcgggctggcaaggc

SEQ ID NO: 537 - DNA, 495 bp, Artificial Sequence
  Oligonucleotide
gcctccctcgcgccatcagtaggagaccttcacgactcctggaactccgaccttatgatacactatcccgaaagaagtcttttacatacccaagacagagagctgggttccactgccaaaaaacagtttttcattgtcgactaggagaccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggtaggagaccttcacgactgagcgggctggcaaggc

SEQ ID NO: 538 - DNA, 495 bp, Artificial Sequence
  Oligonucleotide
gcctccctcgcgccatcaggacactctcttcacgaagagaactctgccttcaagggacaatggccataccaccctgattctgcaacttacctaggatggagagtcgagtcccatcaccaaaatgctggggctgatgtcgacgacactctcttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtgggggacactctcttcacgactgagcgggctggcaaggc

SEQ ID NO: 539 - DNA, 495 bp, Artificial Sequence
  Oligonucleotide
gcctccctcgcgccatcagttcggaaccttcacgaatcattgcagtcaaacccaggcacccccgagtcaagagtggagcccccatacctgtcacagtgagcctggtcccgttcccaaagtggaggggtgaattatgtcgacttcggaaccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggttcggaaccttcacgactgagcgggctggcaaggc

SEQ ID NO: 540 - DNA, 495 bp, Artificial Sequence
  Oligonucleotide
gcctccctcgcgccatcagaagtaacgcttcacgagggtcgtgcaggctgggctgctcaccctctctcccacctggagcccccttcttacctagcacggtgagccgtgtccctggcccgaagaactgctcattgtgtcgacaagtaacgcttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggaagtaacgcttcacgactgagcgggctggcaaggc

SEQ ID NO: 541 - DNA, 495 bp, Artificial Sequence
  Oligonucleotide
gcctccctcgcgccatcaggtctcctacttcacgacctctgcccatcccgccctctcggagctctccggagccccaaccgcctccttacccagtacggtcagcctagagccttctccaaaaaacagctccccggtgtcgacgtctcctacttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtgggggtctcctacttcacgactgagcgggctggcaaggc

SEQ ID NO: 542 - DNA, 495 bp, Artificial Sequence
  Oligonucleotide
gcctccctcgcgccatcaggtagacaccttcacgagcgtcccggggcgccccctccccagttccggggcttcagcgggagcccccgcttaccgagcactgtcagccgggtgcctgggccaaaatactgcgtatctgtcgacgtagacaccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtgggggtagacaccttcacgactgagcgggctggcaaggc

SEQ ID NO: 543 - DNA, 495 bp, Artificial Sequence
  Oligonucleotide
gcctccctcgcgccatcagcactgtaccttcacgacgcacaaaaacccgagcgcagtctcgtccccggtcccccggcggccccagcttacccagcactgagagccgggtcccggcgccgaagtactgaatgttttgtcgaccactgtaccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggcactgtaccttcacgactgagcgggctggcaaggc

SEQ ID NO: 544 - DNA, 495 bp, Artificial Sequence
  Oligonucleotide
gcctccctcgcgccatcaggatgatcccttcacgaccccgcaaaaaccagacccaagccgcccgcgcccgcgccccagcagcccgcgctcaccgagcaccaggagccgcgtgcctggcccgaagtactgggtctcgtcgacgatgatcccttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtgggggatgatcccttcacgactgagcgggctggcaaggc

SEQ ID NO: 545 - DNA, 495 bp, Artificial Sequence
  Oligonucleotide
gcctccctcgcgccatcagcgccaatacttcacgaccgccgccttccacctgaatcccgccgcccgggtggtcccgcgaaaactcacccagcacggtcagcctgctgccggccccgaaagtcaggacgttggcccgtcgaccgccaatacttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggcgccaatacttcacgactgagcgggctggcaaggc

SEQ ID NO: 546 - DNA, 495 bp, Artificial Sequence
  Oligonucleotide
gcctccctcgcgccatcagtcaagcctcttcacgaccaccctccgactccggggaccgaggggctggaaggtggggagacgcccgaatctcacctgtgaccgtgagcctggtgcccggcccgaagtactgctcgtgtcgactcaagcctcttcacgatcactgctggcacagagatacacggccgagtccccaagctctgcaggctggatcttgagagtggagtctactcctttgagcctctctgcagaaaatcgatccttaggcaactgtgaatcgtctactgcttcctcattctcatatcgaatcagaagctccgggccctgtcccaagttctgcaggtaccagtaaagggtattgtggccagaaataggattgcaccaaaaagccacaggctgttttttctctataatcttatatctgggagactgaaccactccagcttctatgagttctgtggggtcaagcctcttcacgactgagcgggctggcaaggc

SEQ ID NO: 547 - DNA, 495 bp, Artificial Sequence
  Oligonucleotide
gcctccctcgcgccatcagagagtgtcagctagtgctgtggacccacttttccctgtgacggatctgcaaaagaacctgaaaaatgtcttacctacaactgtgagtctggtgccttgtccaaagaaagcttcagtgtcgacagagtgtcagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaaagagtgtcagctagtgctgagcgggctggcaaggc

SEQ ID NO: 548 - DNA, 495 bp, Artificial Sequence
  Oligonucleotide
gcctccctcgcgccatcaggttccgaaagctagtgatttcccaggacagagtcctccctcatcgcacccctcctagagacccccagccttacctacaacggttaacctggtccccgaaccgaaggtgtagccatagtcgacgttccgaaagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaagttccgaaagctagtgctgagcgggctggcaaggc

SEQ ID NO: 549 - DNA, 495 bp, Artificial Sequence
  Oligonucleotide
gcctccctcgcgccatcagcgttacttagctagtgctggattccagcccctttttgcaagttcccagctgtccagccttgacttactcacctacaacagtgagccaacttccctctccaaaatatatggtgtttcgtcgaccgttacttagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaacgttacttagctagtgctgagcgggctggcaaggc

SEQ ID NO: 550 - DNA, 495 bp, Artificial Sequence
  Oligonucleotide
gcctccctcgcgccatcagtaggagacagctagtgctcctggaactccgaccttatgatacactatcccgaaagaagtcttttacatacccaagacagagagctgggttccactgccaaaaaacagtttttcattgtcgactaggagacagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaataggagacagctagtgctgagcgggctggcaaggc

SEQ ID NO: 551 - DNA, 495 bp, Artificial Sequence
  Oligonucleotide
gcctccctcgcgccatcaggacactctagctagtgagagaactctgccttcaagggacaatggccataccaccctgattctgcaacttacctaggatggagagtcgagtcccatcaccaaaatgctggggctgatgtcgacgacactctagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaagacactctagctagtgctgagcgggctggcaaggc

SEQ ID NO: 552 - DNA, 495 bp, Artificial Sequence
  Oligonucleotide
gcctccctcgcgccatcagttcggaacagctagtgatcattgcagtcaaacccaggcacccccgagtcaagagtggagcccccatacctgtcacagtgagcctggtcccgttcccaaagtggaggggtgaattatgtcgacttcggaacagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaattcggaacagctagtgctgagcgggctggcaaggc

SEQ ID NO: 553 - DNA, 495 bp, Artificial Sequence
  Oligonucleotide
gcctccctcgcgccatcagaagtaacgagctagtggggtcgtgcaggctgggctgctcaccctctctcccacctggagcccccttcttacctagcacggtgagccgtgtccctggcccgaagaactgctcattgtgtcgacaagtaacgagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaaaagtaacgagctagtgctgagcgggctggcaaggc

SEQ ID NO: 554 - DNA, 495 bp, Artificial Sequence
  Oligonucleotide
gcctccctcgcgccatcaggtctcctaagctagtgcctctgcccatcccgccctctcggagctctccggagccccaaccgcctccttacccagtacggtcagcctagagccttctccaaaaaacagctccccggtgtcgacgtctcctaagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaagtctcctaagctagtgctgagcgggctggcaaggc

SEQ ID NO: 555 - DNA, 495 bp, Artificial Sequence
  Oligonucleotide
gcctccctcgcgccatcaggtagacacagctagtggcgtcccggggcgccccctccccagttccggggcttcagcgggagcccccgcttaccgagcactgtcagccgggtgcctgggccaaaatactgcgtatctgtcgacgtagacacagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaagtagacacagctagtgctgagcgggctggcaaggc

SEQ ID NO: 556 - DNA, 495 bp, Artificial Sequence
  Oligonucleotide
gcctccctcgcgccatcagcactgtacagctagtgcgcacaaaaacccgagcgcagtctcgtccccggtcccccggcggccccagcttacccagcactgagagccgggtcccggcgccgaagtactgaatgttttgtcgaccactgtacagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaacactgtacagctagtgctgagcgggctggcaaggc

SEQ ID NO: 557 - DNA, 495 bp, Artificial Sequence
  Oligonucleotide
gcctccctcgcgccatcaggatgatccagctagtgccccgcaaaaaccagacccaagccgcccgcgcccgcgccccagcagcccgcgctcaccgagcaccaggagccgcgtgcctggcccgaagtactgggtctcgtcgacgatgatccagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaagatgatccagctagtgctgagcgggctggcaaggc

SEQ ID NO: 558 - DNA, 495 bp, Artificial Sequence
  Oligonucleotide
gcctccctcgcgccatcagcgccaataagctagtgccgccgccttccacctgaatcccgccgcccgggtggtcccgcgaaaactcacccagcacggtcagcctgctgccggccccgaaagtcaggacgttggcccgtcgaccgccaataagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaacgccaataagctagtgctgagcgggctggcaaggc

SEQ ID NO: 559 - DNA, 495 bp, Artificial Sequence
  Oligonucleotide
gcctccctcgcgccatcagtcaagcctagctagtgccaccctccgactccggggaccgaggggctggaaggtggggagacgcccgaatctcacctgtgaccgtgagcctggtgcccggcccgaagtactgctcgtgtcgactcaagcctagctagtgtcactgctggcacagaaatataggcccaagtccctgggttccatgggctggatcctcagagtggagaatgatacatcaggcatctgtgctgagaatcaatccttggacactcctgagtcatctacgagggtccagctgcagaagtaattcagcaattccagtccctgcacaaaggtctgtctgtaccagagaagatcattgtggcctgaaattggttcgcatctcagagttactgattgtcccatctctgtcactttgtgcctgggtgactggataacaccagcatctgtgtgtgctataaaatcaagcctagctagtgctgagcgggctggcaaggc

SEQ ID NO: 560 - DNA, 495 bp, Artificial Sequence
  Oligonucleotide
gcctccctcgcgccatcagagagtgtctaaccaagctgtggacccacttttccctgtgacggatctgcaaaagaacctgaaaaatgtcttacctacaactgtgagtctggtgccttgtccaaagaaagcttcagtgtcgacagagtgtctaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaaagagtgtctaaccaagctgagcgggctggcaaggc

SEQ ID NO: 561 - DNA, 495 bp, Artificial Sequence
  Oligonucleotide
gcctccctcgcgccatcaggttccgaataaccaagatttcccaggacagagtcctccctcatcgcacccctcctagagacccccagccttacctacaacggttaacctggtccccgaaccgaaggtgtagccatagtcgacgttccgaataaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaagttccgaataaccaagctgagcgggctggcaaggc

SEQ ID NO: 562 - DNA, 495 bp, Artificial Sequence
  Oligonucleotide
gcctccctcgcgccatcagcgttactttaaccaagctggattccagcccctttttgcaagttcccagctgtccagccttgacttactcacctacaacagtgagccaacttccctctccaaaatatatggtgtttcgtcgaccgttactttaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaacgttactttaaccaagctgagcgggctggcaaggc

SEQ ID NO: 563 - DNA, 495 bp, Artificial Sequence
  Oligonucleotide
gcctccctcgcgccatcagtaggagactaaccaagctcctggaactccgaccttatgatacactatcccgaaagaagtcttttacatacccaagacagagagctgggttccactgccaaaaaacagtttttcattgtcgactaggagactaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaataggagactaaccaagctgagcgggctggcaaggc

SEQ ID NO: 564 - DNA, 495 bp, Artificial Sequence
  Oligonucleotide
gcctccctcgcgccatcaggacactcttaaccaagagagaactctgccttcaagggacaatggccataccaccctgattctgcaacttacctaggatggagagtcgagtcccatcaccaaaatgctggggctgatgtcgacgacactcttaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaagacactcttaaccaagctgagcgggctggcaaggc

SEQ ID NO: 565 - DNA, 495 bp, Artificial Sequence
  Oligonucleotide
gcctccctcgcgccatcagttcggaactaaccaagatcattgcagtcaaacccaggcacccccgagtcaagagtggagcccccatacctgtcacagtgagcctggtcccgttcccaaagtggaggggtgaattatgtcgacttcggaactaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaattcggaactaaccaagctgagcgggctggcaaggc

SEQ ID NO: 566 - DNA, 495 bp, Artificial Sequence
  Oligonucleotide
gcctccctcgcgccatcagaagtaacgtaaccaaggggtcgtgcaggctgggctgctcaccctctctcccacctggagcccccttcttacctagcacggtgagccgtgtccctggcccgaagaactgctcattgtgtcgacaagtaacgtaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaaaagtaacgtaaccaagctgagcgggctggcaaggc

SEQ ID NO: 567 - DNA, 495 bp, Artificial Sequence
  Oligonucleotide
gcctccctcgcgccatcaggtctcctataaccaagcctctgcccatcccgccctctcggagctctccggagccccaaccgcctccttacccagtacggtcagcctagagccttctccaaaaaacagctccccggtgtcgacgtctcctataaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaagtctcctataaccaagctgagcgggctggcaaggc

SEQ ID NO: 568 - DNA, 495 bp, Artificial Sequence
  Oligonucleotide
gcctccctcgcgccatcaggtagacactaaccaaggcgtcccggggcgccccctccccagttccggggcttcagcgggagcccccgcttaccgagcactgtcagccgggtgcctgggccaaaatactgcgtatctgtcgacgtagacactaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaagtagacactaaccaagctgagcgggctggcaaggc

SEQ ID NO: 569 - DNA, 495 bp, Artificial Sequence
  Oligonucleotide
gcctccctcgcgccatcagcactgtactaaccaagcgcacaaaaacccgagcgcagtctcgtccccggtcccccggcggccccagcttacccagcactgagagccgggtcccggcgccgaagtactgaatgttttgtcgaccactgtactaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaacactgtactaaccaagctgagcgggctggcaaggc

SEQ ID NO: 570 - DNA, 495 bp, Artificial Sequence
  Oligonucleotide
gcctccctcgcgccatcaggatgatcctaaccaagccccgcaaaaaccagacccaagccgcccgcgcccgcgccccagcagcccgcgctcaccgagcaccaggagccgcgtgcctggcccgaagtactgggtctcgtcgacgatgatcctaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaagatgatcctaaccaagctgagcgggctggcaaggc

SEQ ID NO: 571 - DNA, 495 bp, Artificial Sequence
  Oligonucleotide
gcctccctcgcgccatcagcgccaatataaccaagccgccgccttccacctgaatcccgccgcccgggtggtcccgcgaaaactcacccagcacggtcagcctgctgccggccccgaaagtcaggacgttggcccgtcgaccgccaatataaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaacgccaatataaccaagctgagcgggctggcaaggc

SEQ ID NO: 572 - DNA, 495 bp, Artificial Sequence
  Oligonucleotide
gcctccctcgcgccatcagtcaagccttaaccaagccaccctccgactccggggaccgaggggctggaaggtggggagacgcccgaatctcacctgtgaccgtgagcctggtgcccggcccgaagtactgctcgtgtcgactcaagccttaaccaagtcacgacttgcacagacatacacggccgagtccccctgctctgcaggctggatcttcagagtagagaatgatccatcaggcctctcagctgagaatcgctctgtgggcatacctgcattatctataatagatcagctccggaagtaactcagcaattccagtccctgcacgaaggtatctctgtaccagaaaaggaaattgtggccaaaaattggctcacatctcagagtcactgtttgtcccatttctgtcacctcatgcttgggtgactggataatgccagcatctgtgcatgctataaaatcaagccttaaccaagctgagcgggctggcaaggc

SEQ ID NO: 573 - DNA, 495 bp, Artificial Sequence
  Oligonucleotide
gcctccctcgcgccatcagagagtgtccaagaggtctgtggacccacttttccctgtgacggatctgcaaaagaacctgaaaaatgtcttacctacaactgtgagtctggtgccttgtccaaagaaagcttcagtgtcgacagagtgtccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaaagagtgtccaagaggtctgagcgggctggcaaggc

SEQ ID NO: 574 - DNA, 495 bp, Artificial Sequence
  Oligonucleotide
gcctccctcgcgccatcaggttccgaacaagaggtatttcccaggacagagtcctccctcatcgcacccctcctagagacccccagccttacctacaacggttaacctggtccccgaaccgaaggtgtagccatagtcgacgttccgaacaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaagttccgaacaagaggtctgagcgggctggcaaggc

SEQ ID NO: 575 - DNA, 495 bp, Artificial Sequence
  Oligonucleotide
gcctccctcgcgccatcagcgttacttcaagaggtctggattccagcccctttttgcaagttcccagctgtccagccttgacttactcacctacaacagtgagccaacttccctctccaaaatatatggtgtttcgtcgaccgttacttcaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaacgttacttcaagaggtctgagcgggctggcaaggc

SEQ ID NO: 576 - DNA, 495 bp, Artificial Sequence
  Oligonucleotide
gcctccctcgcgccatcagtaggagaccaagaggtctcctggaactccgaccttatgatacactatcccgaaagaagtcttttacatacccaagacagagagctgggttccactgccaaaaaacagtttttcattgtcgactaggagaccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaataggagaccaagaggtctgagcgggctggcaaggc

SEQ ID NO: 577 - DNA, 495 bp, Artificial Sequence
  Oligonucleotide
gcctccctcgcgccatcaggacactctcaagaggtagagaactctgccttcaagggacaatggccataccaccctgattctgcaacttacctaggatggagagtcgagtcccatcaccaaaatgctggggctgatgtcgacgacactctcaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaagacactctcaagaggtctgagcgggctggcaaggc

SEQ ID NO: 578 - DNA, 495 bp, Artificial Sequence
  Oligonucleotide
gcctccctcgcgccatcagttcggaaccaagaggtatcattgcagtcaaacccaggcacccccgagtcaagagtggagcccccatacctgtcacagtgagcctggtcccgttcccaaagtggaggggtgaattatgtcgacttcggaaccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaattcggaaccaagaggtctgagcgggctggcaaggc

SEQ ID NO: 579 - DNA, 495 bp, Artificial Sequence
  Oligonucleotide
gcctccctcgcgccatcagaagtaacgcaagaggtgggtcgtgcaggctgggctgctcaccctctctcccacctggagcccccttcttacctagcacggtgagccgtgtccctggcccgaagaactgctcattgtgtcgacaagtaacgcaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaaaagtaacgcaagaggtctgagcgggctggcaaggc

SEQ ID NO: 580 - DNA, 495 bp, Artificial Sequence
  Oligonucleotide
gcctccctcgcgccatcaggtctcctacaagaggtcctctgcccatcccgccctctcggagctctccggagccccaaccgcctccttacccagtacggtcagcctagagccttctccaaaaaacagctccccggtgtcgacgtctcctacaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaagtctcctacaagaggtctgagcgggctggcaaggc

SEQ ID NO: 581 - DNA, 495 bp, Artificial Sequence
  Oligonucleotide
gcctccctcgcgccatcaggtagacaccaagaggtgcgtcccggggcgccccctccccagttccggggcttcagcgggagcccccgcttaccgagcactgtcagccgggtgcctgggccaaaatactgcgtatctgtcgacgtagacaccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaagtagacaccaagaggtctgagcgggctggcaaggc

SEQ ID NO: 582 - DNA, 495 bp, Artificial Sequence
  Oligonucleotide
gcctccctcgcgccatcagcactgtaccaagaggtcgcacaaaaacccgagcgcagtctcgtccccggtcccccggcggccccagcttacccagcactgagagccgggtcccggcgccgaagtactgaatgttttgtcgaccactgtaccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaacactgtaccaagaggtctgagcgggctggcaaggc

SEQ ID NO: 583 - DNA, 495 bp, Artificial Sequence
  Oligonucleotide
gcctccctcgcgccatcaggatgatcccaagaggtccccgcaaaaaccagacccaagccgcccgcgcccgcgccccagcagcccgcgctcaccgagcaccaggagccgcgtgcctggcccgaagtactgggtctcgtcgacgatgatcccaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaagatgatcccaagaggtctgagcgggctggcaaggc

SEQ ID NO: 584 - DNA, 495 bp, Artificial Sequence
  Oligonucleotide
gcctccctcgcgccatcagcgccaatacaagaggtccgccgccttccacctgaatcccgccgcccgggtggtcccgcgaaaactcacccagcacggtcagcctgctgccggccccgaaagtcaggacgttggcccgtcgaccgccaatacaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaacgccaatacaagaggtctgagcgggctggcaaggc

SEQ ID NO: 585 - DNA, 495 bp, Artificial Sequence
  Oligonucleotide
gcctccctcgcgccatcagtcaagcctcaagaggtccaccctccgactccggggaccgaggggctggaaggtggggagacgcccgaatctcacctgtgaccgtgagcctggtgcccggcccgaagtactgctcgtgtcgactcaagcctcaagaggttcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaagggagttgtggcctgaaattggtttacatctcagagtcacttcttgtcccatctctgtcacctcatggcggggtgactggataactccagcatctgtatgctctatgaaatcaagcctcaagaggtctgagcgggctggcaaggc

SEQ ID NO: 586 - DNA, 495 bp, Artificial Sequence
  Oligonucleotide
gcctccctcgcgccatcagagagtgtcagaatcagctgtggacccacttttccctgtgacggatctgcaaaagaacctgaaaaatgtcttacctacaactgtgagtctggtgccttgtccaaagaaagcttcagtgtcgacagagtgtcagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagagagtgtcagaatcagctgagcgggctggcaaggc

SEQ ID NO: 587 - DNA, 495 bp, Artificial Sequence
  Oligonucleotide
gcctccctcgcgccatcaggttccgaaagaatcagatttcccaggacagagtcctccctcatcgcacccctcctagagacccccagccttacctacaacggttaacctggtccccgaaccgaaggtgtagccatagtcgacgttccgaaagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaaggttccgaaagaatcagctgagcgggctggcaaggc

SEQ ID NO: 588 - DNA, 495 bp, Artificial Sequence
  Oligonucleotide
gcctccctcgcgccatcagcgttacttagaatcagctggattccagcccctttttgcaagttcccagctgtccagccttgacttactcacctacaacagtgagccaacttccctctccaaaatatatggtgtttcgtcgaccgttacttagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagcgttacttagaatcagctgagcgggctggcaaggc

SEQ ID NO: 589 - DNA, 495 bp, Artificial Sequence
  Oligonucleotide
gcctccctcgcgccatcagtaggagacagaatcagctcctggaactccgaccttatgatacactatcccgaaagaagtcttttacatacccaagacagagagctgggttccactgccaaaaaacagtttttcattgtcgactaggagacagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagtaggagacagaatcagctgagcgggctggcaaggc

SEQ ID NO: 590 - DNA, 495 bp, Artificial Sequence
  Oligonucleotide
gcctccctcgcgccatcaggacactctagaatcagagagaactctgccttcaagggacaatggccataccaccctgattctgcaacttacctaggatggagagtcgagtcccatcaccaaaatgctggggctgatgtcgacgacactctagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaaggacactctagaatcagctgagcgggctggcaaggc

SEQ ID NO: 591 - DNA, 495 bp, Artificial Sequence
  Oligonucleotide
gcctccctcgcgccatcagttcggaacagaatcagatcattgcagtcaaacccaggcacccccgagtcaagagtggagcccccatacctgtcacagtgagcctggtcccgttcccaaagtggaggggtgaattatgtcgacttcggaacagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagttcggaacagaatcagctgagcgggctggcaaggc

SEQ ID NO: 592 - DNA, 495 bp, Artificial Sequence
  Oligonucleotide
gcctccctcgcgccatcagaagtaacgagaatcaggggtcgtgcaggctgggctgctcaccctctctcccacctggagcccccttcttacctagcacggtgagccgtgtccctggcccgaagaactgctcattgtgtcgacaagtaacgagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagaagtaacgagaatcagctgagcgggctggcaaggc

SEQ ID NO: 593 - DNA, 495 bp, Artificial Sequence
  Oligonucleotide
gcctccctcgcgccatcaggtctcctaagaatcagcctctgcccatcccgccctctcggagctctccggagccccaaccgcctccttacccagtacggtcagcctagagccttctccaaaaaacagctccccggtgtcgacgtctcctaagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaaggtctcctaagaatcagctgagcgggctggcaaggc

SEQ ID NO: 594 - DNA, 495 bp, Artificial Sequence
  Oligonucleotide
gcctccctcgcgccatcaggtagacacagaatcaggcgtcccggggcgccccctccccagttccggggcttcagcgggagcccccgcttaccgagcactgtcagccgggtgcctgggccaaaatactgcgtatctgtcgacgtagacacagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaaggtagacacagaatcagctgagcgggctggcaaggc

SEQ ID NO: 595 - DNA, 495 bp, Artificial Sequence
  Oligonucleotide
gcctccctcgcgccatcagcactgtacagaatcagcgcacaaaaacccgagcgcagtctcgtccccggtcccccggcggccccagcttacccagcactgagagccgggtcccggcgccgaagtactgaatgttttgtcgaccactgtacagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagcactgtacagaatcagctgagcgggctggcaaggc

SEQ ID NO: 596 - DNA, 495 bp, Artificial Sequence
  Oligonucleotide
gcctccctcgcgccatcaggatgatccagaatcagccccgcaaaaaccagacccaagccgcccgcgcccgcgccccagcagcccgcgctcaccgagcaccaggagccgcgtgcctggcccgaagtactgggtctcgtcgacgatgatccagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaaggatgatccagaatcagctgagcgggctggcaaggc

SEQ ID NO: 597 - DNA, 495 bp, Artificial Sequence
  Oligonucleotide
gcctccctcgcgccatcagcgccaataagaatcagccgccgccttccacctgaatcccgccgcccgggtggtcccgcgaaaactcacccagcacggtcagcctgctgccggccccgaaagtcaggacgttggcccgtcgaccgccaataagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagcgccaataagaatcagctgagcgggctggcaaggc

SEQ ID NO: 598 - DNA, 495 bp, Artificial Sequence
  Oligonucleotide
gcctccctcgcgccatcagtcaagcctagaatcagccaccctccgactccggggaccgaggggctggaaggtggggagacgcccgaatctcacctgtgaccgtgagcctggtgcccggcccgaagtactgctcgtgtcgactcaagcctagaatcagtcactgctggcacagaagtacacagctgagtccctgggttctgagggctggatcttcagagtggagaatgatgcattaggcatcttagctgagaatcgatcctcgggcatccctgaatcatctatcggaacgttgttgttaaagtaaatgagcaactccagtccccgcatcatggtctgtctgtaccagaaaaggtagtcgtgtcctgaaattggtttacatctcagagtcacttcttgtcccatctctgtcacctcgtgccggggtgactggataactccagcatctgtgtgctctatgaagtcaagcctagaatcagctgagcgggctggcaaggc

SEQ ID NO: 599 - DNA, 495 bp, Artificial Sequence
  Oligonucleotide
gcctccctcgcgccatcagagagtgtcagttgaccctgtggacccacttttccctgtgacggatctgcaaaagaacctgaaaaatgtcttacctacaactgtgagtctggtgccttgtccaaagaaagcttcagtgtcgacagagtgtcagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaaagagtgtcagttgaccctgagcgggctggcaaggc

SEQ ID NO: 600 - DNA, 495 bp, Artificial Sequence
  Oligonucleotide
gcctccctcgcgccatcaggttccgaaagttgaccatttcccaggacagagtcctccctcatcgcacccctcctagagacccccagccttacctacaacggttaacctggtccccgaaccgaaggtgtagccatagtcgacgttccgaaagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaagttccgaaagttgaccctgagcgggctggcaaggc

SEQ ID NO: 601 - DNA, 495 bp, Artificial Sequence
  Oligonucleotide
gcctccctcgcgccatcagcgttacttagttgaccctggattccagcccctttttgcaagttcccagctgtccagccttgacttactcacctacaacagtgagccaacttccctctccaaaatatatggtgtttcgtcgaccgttacttagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaacgttacttagttgaccctgagcgggctggcaaggc

SEQ ID NO: 602 - DNA, 495 bp, Artificial Sequence
  Oligonucleotide
gcctccctcgcgccatcagtaggagacagttgaccctcctggaactccgaccttatgatacactatcccgaaagaagtcttttacatacccaagacagagagctgggttccactgccaaaaaacagtttttcattgtcgactaggagacagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaataggagacagttgaccctgagcgggctggcaaggc

SEQ ID NO: 603 - DNA, 495 bp, Artificial Sequence
  Oligonucleotide
gcctccctcgcgccatcaggacactctagttgaccagagaactctgccttcaagggacaatggccataccaccctgattctgcaacttacctaggatggagagtcgagtcccatcaccaaaatgctggggctgatgtcgacgacactctagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaagacactctagttgaccctgagcgggctggcaaggc

SEQ ID NO: 604 - DNA, 495 bp, Artificial Sequence
  Oligonucleotide
gcctccctcgcgccatcagttcggaacagttgaccatcattgcagtcaaacccaggcacccccgagtcaagagtggagcccccatacctgtcacagtgagcctggtcccgttcccaaagtggaggggtgaattatgtcgacttcggaacagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaattcggaacagttgaccctgagcgggctggcaaggc

SEQ ID NO: 605 - DNA, 495 bp, Artificial Sequence
  Oligonucleotide
gcctccctcgcgccatcagaagtaacgagttgaccgggtcgtgcaggctgggctgctcaccctctctcccacctggagcccccttcttacctagcacggtgagccgtgtccctggcccgaagaactgctcattgtgtcgacaagtaacgagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaaaagtaacgagttgaccctgagcgggctggcaaggc

SEQ ID NO: 606 - DNA, 495 bp, Artificial Sequence
  Oligonucleotide
gcctccctcgcgccatcaggtctcctaagttgacccctctgcccatcccgccctctcggagctctccggagccccaaccgcctccttacccagtacggtcagcctagagccttctccaaaaaacagctccccggtgtcgacgtctcctaagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaagtctcctaagttgaccctgagcgggctggcaaggc

SEQ ID NO: 607 - DNA, 495 bp, Artificial Sequence
  Oligonucleotide
gcctccctcgcgccatcaggtagacacagttgaccgcgtcccggggcgccccctccccagttccggggcttcagcgggagcccccgcttaccgagcactgtcagccgggtgcctgggccaaaatactgcgtatctgtcgacgtagacacagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaagtagacacagttgaccctgagcgggctggcaaggc

SEQ ID NO: 608 - DNA, 495 bp, Artificial Sequence
  Oligonucleotide
gcctccctcgcgccatcagcactgtacagttgacccgcacaaaaacccgagcgcagtctcgtccccggtcccccggcggccccagcttacccagcactgagagccgggtcccggcgccgaagtactgaatgttttgtcgaccactgtacagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaacactgtacagttgaccctgagcgggctggcaaggc

SEQ ID NO: 609 - DNA, 495 bp, Artificial Sequence
  Oligonucleotide
gcctccctcgcgccatcaggatgatccagttgaccccccgcaaaaaccagacccaagccgcccgcgcccgcgccccagcagcccgcgctcaccgagcaccaggagccgcgtgcctggcccgaagtactgggtctcgtcgacgatgatccagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaagatgatccagttgaccctgagcgggctggcaaggc

SEQ ID NO: 610 - DNA, 495 bp, Artificial Sequence
  Oligonucleotide
gcctccctcgcgccatcagcgccaataagttgaccccgccgccttccacctgaatcccgccgcccgggtggtcccgcgaaaactcacccagcacggtcagcctgctgccggccccgaaagtcaggacgttggcccgtcgaccgccaataagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaacgccaataagttgaccctgagcgggctggcaaggc

SEQ ID NO: 611 - DNA, 495 bp, Artificial Sequence
  Oligonucleotide
gcctccctcgcgccatcagtcaagcctagttgaccccaccctccgactccggggaccgaggggctggaaggtggggagacgcccgaatctcacctgtgaccgtgagcctggtgcccggcccgaagtactgctcgtgtcgactcaagcctagttgacctcaccactagcacaaaaatacacagctgagtccctgggttctgagggctggatcttcagagtggctaaagttgcatcaggcatctctgctgagaatcgatccttcggcatccccgaatcatctagaggagcccggttgcggaagtaagccagcaactccagtccttgcatcatggtctgtctgtaccagaaaacagtattgtggcctaaaattggctgacatctcattgttacttcttgtcccatctctgtcaccttgtgccttggtgtctgggtgactctagcatctataagctctgtgaaatcaagcctagttgaccctgagcgggctggcaaggc

SEQ ID NO: 612 - DNA, 495 bp, Artificial Sequence
  Oligonucleotide
gcctccctcgcgccatcagagagtgtcagttatgcctgtggacccacttttccctgtgacggatctgcaaaagaacctgaaaaatgtcttacctacaactgtgagtctggtgccttgtccaaagaaagcttcagtgtcgacagagtgtcagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaaagagtgtcagttatgcctgagcgggctggcaaggc

SEQ ID NO: 613 - DNA, 495 bp, Artificial Sequence
  Oligonucleotide
gcctccctcgcgccatcaggttccgaaagttatgcatttcccaggacagagtcctccctcatcgcacccctcctagagacccccagccttacctacaacggttaacctggtccccgaaccgaaggtgtagccatagtcgacgttccgaaagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaagttccgaaagttatgcctgagcgggctggcaaggc

SEQ ID NO: 614 - DNA, 495 bp, Artificial Sequence
  Oligonucleotide
gcctccctcgcgccatcagcgttacttagttatgcctggattccagcccctttttgcaagttcccagctgtccagccttgacttactcacctacaacagtgagccaacttccctctccaaaatatatggtgtttcgtcgaccgttacttagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaacgttacttagttatgcctgagcgggctggcaaggc

SEQ ID NO: 615 - DNA, 495 bp, Artificial Sequence
  Oligonucleotide
gcctccctcgcgccatcagtaggagacagttatgcctcctggaactccgaccttatgatacactatcccgaaagaagtcttttacatacccaagacagagagctgggttccactgccaaaaaacagtttttcattgtcgactaggagacagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaataggagacagttatgcctgagcgggctggcaaggc

SEQ ID NO: 616 - DNA, 495 bp, Artificial Sequence
  Oligonucleotide
gcctccctcgcgccatcaggacactctagttatgcagagaactctgccttcaagggacaatggccataccaccctgattctgcaacttacctaggatggagagtcgagtcccatcaccaaaatgctggggctgatgtcgacgacactctagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaagacactctagttatgcctgagcgggctggcaaggc

SEQ ID NO: 617 - DNA, 495 bp, Artificial Sequence
  Oligonucleotide
gcctccctcgcgccatcagttcggaacagttatgcatcattgcagtcaaacccaggcacccccgagtcaagagtggagcccccatacctgtcacagtgagcctggtcccgttcccaaagtggaggggtgaattatgtcgacttcggaacagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaattcggaacagttatgcctgagcgggctggcaaggc

SEQ ID NO: 618 - DNA, 495 bp, Artificial Sequence
  Oligonucleotide
gcctccctcgcgccatcagaagtaacgagttatgcgggtcgtgcaggctgggctgctcaccctctctcccacctggagcccccttcttacctagcacggtgagccgtgtccctggcccgaagaactgctcattgtgtcgacaagtaacgagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaaaagtaacgagttatgcctgagcgggctggcaaggc

SEQ ID NO: 619 - DNA, 495 bp, Artificial Sequence
  Oligonucleotide
gcctccctcgcgccatcaggtctcctaagttatgccctctgcccatcccgccctctcggagctctccggagccccaaccgcctccttacccagtacggtcagcctagagccttctccaaaaaacagctccccggtgtcgacgtctcctaagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaagtctcctaagttatgcctgagcgggctggcaaggc

SEQ ID NO: 620 - DNA, 495 bp, Artificial Sequence
  Oligonucleotide
gcctccctcgcgccatcaggtagacacagttatgcgcgtcccggggcgccccctccccagttccggggcttcagcgggagcccccgcttaccgagcactgtcagccgggtgcctgggccaaaatactgcgtatctgtcgacgtagacacagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaagtagacacagttatgcctgagcgggctggcaaggc

SEQ ID NO: 621 - DNA, 495 bp, Artificial Sequence
  Oligonucleotide
gcctccctcgcgccatcagcactgtacagttatgccgcacaaaaacccgagcgcagtctcgtccccggtcccccggcggccccagcttacccagcactgagagccgggtcccggcgccgaagtactgaatgttttgtcgaccactgtacagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaacactgtacagttatgcctgagcgggctggcaaggc

SEQ ID NO: 622 - DNA, 495 bp, Artificial Sequence
  Oligonucleotide
gcctccctcgcgccatcaggatgatccagttatgcccccgcaaaaaccagacccaagccgcccgcgcccgcgccccagcagcccgcgctcaccgagcaccaggagccgcgtgcctggcccgaagtactgggtctcgtcgacgatgatccagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaagatgatccagttatgcctgagcgggctggcaaggc

SEQ ID NO: 623 - DNA, 495 bp, Artificial Sequence
  Oligonucleotide
gcctccctcgcgccatcagcgccaataagttatgcccgccgccttccacctgaatcccgccgcccgggtggtcccgcgaaaactcacccagcacggtcagcctgctgccggccccgaaagtcaggacgttggcccgtcgaccgccaataagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaacgccaataagttatgcctgagcgggctggcaaggc

SEQ ID NO: 624 - DNA, 495 bp, Artificial Sequence
  Oligonucleotide
gcctccctcgcgccatcagtcaagcctagttatgcccaccctccgactccggggaccgaggggctggaaggtggggagacgcccgaatctcacctgtgaccgtgagcctggtgcccggcccgaagtactgctcgtgtcgactcaagcctagttatgctcactgctggcacagaagtacagggctgagtcccccagctccaaggagctcatgttcagttcagaatgatagtcactgaactgttgagctgagaatcgatcagggatgcttcctttatcgctctgcatcttttcataaaacgaaatgaggaactgggggtcctgacctggaccctgctggtaccagtagacagtgtcgtgtctagggataggatagcatttcagagtggctgtttccctcttttctttgatcagatgtcttggggactggatgactccagcagccactgaaactgtggaggaatcaagcctagttatgcctgagcgggctggcaaggc

SEQ ID NO: 625 - DNA, 495 bp, Artificial Sequence
  Oligonucleotide
gcctccctcgcgccatcagagagtgtccagcatatctgtggacccacttttccctgtgacggatctgcaaaagaacctgaaaaatgtcttacctacaactgtgagtctggtgccttgtccaaagaaagcttcagtgtcgacagagtgtccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggaagagtgtccagcatatctgagcgggctggcaaggc

SEQ ID NO: 626 - DNA, 495 bp, Artificial Sequence
  Oligonucleotide
gcctccctcgcgccatcaggttccgaacagcatatatttcccaggacagagtcctccctcatcgcacccctcctagagacccccagccttacctacaacggttaacctggtccccgaaccgaaggtgtagccatagtcgacgttccgaacagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggagttccgaacagcatatctgagcgggctggcaaggc

SEQ ID NO: 627 - DNA, 495 bp, Artificial Sequence
  Oligonucleotide
gcctccctcgcgccatcagcgttacttcagcatatctggattccagcccctttttgcaagttcccagctgtccagccttgacttactcacctacaacagtgagccaacttccctctccaaaatatatggtgtttcgtcgaccgttacttcagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggacgttacttcagcatatctgagcgggctggcaaggc

SEQ ID NO: 628 - DNA, 495 bp, Artificial Sequence
  Oligonucleotide
gcctccctcgcgccatcagtaggagaccagcatatctcctggaactccgaccttatgatacactatcccgaaagaagtcttttacatacccaagacagagagctgggttccactgccaaaaaacagtttttcattgtcgactaggagaccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggataggagaccagcatatctgagcgggctggcaaggc

SEQ ID NO: 629 - DNA, 495 bp, Artificial Sequence
  Oligonucleotide
gcctccctcgcgccatcaggacactctcagcatatagagaactctgccttcaagggacaatggccataccaccctgattctgcaacttacctaggatggagagtcgagtcccatcaccaaaatgctggggctgatgtcgacgacactctcagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggagacactctcagcatatctgagcgggctggcaaggc

SEQ ID NO: 630 - DNA, 495 bp, Artificial Sequence
  Oligonucleotide
gcctccctcgcgccatcagttcggaaccagcatatatcattgcagtcaaacccaggcacccccgagtcaagagtggagcccccatacctgtcacagtgagcctggtcccgttcccaaagtggaggggtgaattatgtcgacttcggaaccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggattcggaaccagcatatctgagcgggctggcaaggc

SEQ ID NO: 631 - DNA, 495 bp, Artificial Sequence
  Oligonucleotide
gcctccctcgcgccatcagaagtaacgcagcatatgggtcgtgcaggctgggctgctcaccctctctcccacctggagcccccttcttacctagcacggtgagccgtgtccctggcccgaagaactgctcattgtgtcgacaagtaacgcagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggaaagtaacgcagcatatctgagcgggctggcaaggc

SEQ ID NO: 632 - DNA, 495 bp, Artificial Sequence
  Oligonucleotide
gcctccctcgcgccatcaggtctcctacagcatatcctctgcccatcccgccctctcggagctctccggagccccaaccgcctccttacccagtacggtcagcctagagccttctccaaaaaacagctccccggtgtcgacgtctcctacagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggagtctcctacagcatatctgagcgggctggcaaggc

SEQ ID NO: 633 - DNA, 495 bp, Artificial Sequence
  Oligonucleotide
gcctccctcgcgccatcaggtagacaccagcatatgcgtcccggggcgccccctccccagttccggggcttcagcgggagcccccgcttaccgagcactgtcagccgggtgcctgggccaaaatactgcgtatctgtcgacgtagacaccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggagtagacaccagcatatctgagcgggctggcaaggc

SEQ ID NO: 634 - DNA, 495 bp, Artificial Sequence
  Oligonucleotide
gcctccctcgcgccatcagcactgtaccagcatatcgcacaaaaacccgagcgcagtctcgtccccggtcccccggcggccccagcttacccagcactgagagccgggtcccggcgccgaagtactgaatgttttgtcgaccactgtaccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggacactgtaccagcatatctgagcgggctggcaaggc

SEQ ID NO: 635 - DNA, 495 bp, Artificial Sequence
  Oligonucleotide
gcctccctcgcgccatcaggatgatcccagcatatccccgcaaaaaccagacccaagccgcccgcgcccgcgccccagcagcccgcgctcaccgagcaccaggagccgcgtgcctggcccgaagtactgggtctcgtcgacgatgatcccagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggagatgatcccagcatatctgagcgggctggcaaggc

SEQ ID NO: 636 - DNA, 495 bp, Artificial Sequence
  Oligonucleotide
gcctccctcgcgccatcagcgccaatacagcatatccgccgccttccacctgaatcccgccgcccgggtggtcccgcgaaaactcacccagcacggtcagcctgctgccggccccgaaagtcaggacgttggcccgtcgaccgccaatacagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggacgccaatacagcatatctgagcgggctggcaaggc

SEQ ID NO: 637 - DNA, 495 bp, Artificial Sequence
  Oligonucleotide
gcctccctcgcgccatcagtcaagcctcagcatatccaccctccgactccggggaccgaggggctggaaggtggggagacgcccgaatctcacctgtgaccgtgagcctggtgcccggcccgaagtactgctcgtgtcgactcaagcctcagcatattcactgctggcacagaaataaactccagaatcctccagttctgcaggctgcaccttcagagtagaatacgtccctccagtcctttcagctaagaatcgattgttgggcataccggactcatcctgtttagactctttcacaaaatgtaacagaaattttatttcttttcccataacacgtcgataccaataaagattatcatgtccagaaattgggtcacatctcagagtcacagtctggcccttctctattacgctgtggctggggaactgagtaactccagcttctatgtgctctgtgggatcaagcctcagcatatctgagcgggctggcaaggc

SEQ ID NO: 638 - DNA, 495 bp, Artificial Sequence
  Oligonucleotide
gcctccctcgcgccatcagagagtgtcgcaggattctgtggacccacttttccctgtgacggatctgcaaaagaacctgaaaaatgtcttacctacaactgtgagtctggtgccttgtccaaagaaagcttcagtgtcgacagagtgtcgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaaagagtgtcgcaggattctgagcgggctggcaaggc

SEQ ID NO: 639 - DNA, 495 bp, Artificial Sequence
  Oligonucleotide
gcctccctcgcgccatcaggttccgaagcaggattatttcccaggacagagtcctccctcatcgcacccctcctagagacccccagccttacctacaacggttaacctggtccccgaaccgaaggtgtagccatagtcgacgttccgaagcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaagttccgaagcaggattctgagcgggctggcaaggc

SEQ ID NO: 640 - DNA, 495 bp, Artificial Sequence
  Oligonucleotide
gcctccctcgcgccatcagcgttacttgcaggattctggattccagcccctttttgcaagttcccagctgtccagccttgacttactcacctacaacagtgagccaacttccctctccaaaatatatggtgtttcgtcgaccgttacttgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaacgttacttgcaggattctgagcgggctggcaaggc

SEQ ID NO: 641 - DNA, 495 bp, Artificial Sequence
  Oligonucleotide
gcctccctcgcgccatcagtaggagacgcaggattctcctggaactccgaccttatgatacactatcccgaaagaagtcttttacatacccaagacagagagctgggttccactgccaaaaaacagtttttcattgtcgactaggagacgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaataggagacgcaggattctgagcgggctggcaaggc

SEQ ID NO: 642 - DNA, 495 bp, Artificial Sequence
  Oligonucleotide
gcctccctcgcgccatcaggacactctgcaggattagagaactctgccttcaagggacaatggccataccaccctgattctgcaacttacctaggatggagagtcgagtcccatcaccaaaatgctggggctgatgtcgacgacactctgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaagacactctgcaggattctgagcgggctggcaaggc

SEQ ID NO: 643 - DNA, 495 bp, Artificial Sequence
  Oligonucleotide
gcctccctcgcgccatcagttcggaacgcaggattatcattgcagtcaaacccaggcacccccgagtcaagagtggagcccccatacctgtcacagtgagcctggtcccgttcccaaagtggaggggtgaattatgtcgacttcggaacgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaattcggaacgcaggattctgagcgggctggcaaggc

SEQ ID NO: 644 - DNA, 495 bp, Artificial Sequence
  Oligonucleotide
gcctccctcgcgccatcagaagtaacggcaggattgggtcgtgcaggctgggctgctcaccctctctcccacctggagcccccttcttacctagcacggtgagccgtgtccctggcccgaagaactgctcattgtgtcgacaagtaacggcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaaaagtaacggcaggattctgagcgggctggcaaggc

SEQ ID NO: 645 - DNA, 495 bp, Artificial Sequence
  Oligonucleotide
gcctccctcgcgccatcaggtctcctagcaggattcctctgcccatcccgccctctcggagctctccggagccccaaccgcctccttacccagtacggtcagcctagagccttctccaaaaaacagctccccggtgtcgacgtctcctagcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaagtctcctagcaggattctgagcgggctggcaaggc

SEQ ID NO: 646 - DNA, 495 bp, Artificial Sequence
  Oligonucleotide
gcctccctcgcgccatcaggtagacacgcaggattgcgtcccggggcgccccctccccagttccggggcttcagcgggagcccccgcttaccgagcactgtcagccgggtgcctgggccaaaatactgcgtatctgtcgacgtagacacgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaagtagacacgcaggattctgagcgggctggcaaggc

SEQ ID NO: 647 - DNA, 495 bp, Artificial Sequence
  Oligonucleotide
gcctccctcgcgccatcagcactgtacgcaggattcgcacaaaaacccgagcgcagtctcgtccccggtcccccggcggccccagcttacccagcactgagagccgggtcccggcgccgaagtactgaatgttttgtcgaccactgtacgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaacactgtacgcaggattctgagcgggctggcaaggc

SEQ ID NO: 648 - DNA, 495 bp, Artificial Sequence
  Oligonucleotide
gcctccctcgcgccatcaggatgatccgcaggattccccgcaaaaaccagacccaagccgcccgcgcccgcgccccagcagcccgcgctcaccgagcaccaggagccgcgtgcctggcccgaagtactgggtctcgtcgacgatgatccgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaagatgatccgcaggattctgagcgggctggcaaggc

SEQ ID NO: 649 - DNA, 495 bp, Artificial Sequence
  Oligonucleotide
gcctccctcgcgccatcagcgccaatagcaggattccgccgccttccacctgaatcccgccgcccgggtggtcccgcgaaaactcacccagcacggtcagcctgctgccggccccgaaagtcaggacgttggcccgtcgaccgccaatagcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaacgccaatagcaggattctgagcgggctggcaaggc

SEQ ID NO: 650 - DNA, 495 bp, Artificial Sequence
  Oligonucleotide
gcctccctcgcgccatcagtcaagcctgcaggattccaccctccgactccggggaccgaggggctggaaggtggggagacgcccgaatctcacctgtgaccgtgagcctggtgcccggcccgaagtactgctcgtgtcgactcaagcctgcaggatttcactggtggcacacaggtacatggctgtgtcccccaggcctggtgagcggatgtcaagaaagcagaaagaagtgttcggcctcctggattggaagttatcaggggtgtctgcttcattgttaaaatctttgtcatagtagtggaacagcagctttggggcctgacttgacttctgctggtaccagtacatgacgttatggttcaaagtctgagaacaactcagggtcactggctttccaaactgggtaacctggtatcttgggttctggatgaccatggcatccccatgacctgtagagaaatcaagcctgcaggattctgagcgggctggcaaggc

SEQ ID NO: 651 - DNA, 495 bp, Artificial Sequence
  Oligonucleotide
gcctccctcgcgccatcagagagtgtcaggtctcactgtggacccacttttccctgtgacggatctgcaaaagaacctgaaaaatgtcttacctacaactgtgagtctggtgccttgtccaaagaaagcttcagtgtcgacagagtgtcaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagagagtgtcaggtctcactgagcgggctggcaaggc

SEQ ID NO: 652 - DNA, 495 bp, Artificial Sequence
  Oligonucleotide
gcctccctcgcgccatcaggttccgaaaggtctcaatttcccaggacagagtcctccctcatcgcacccctcctagagacccccagccttacctacaacggttaacctggtccccgaaccgaaggtgtagccatagtcgacgttccgaaaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaaggttccgaaaggtctcactgagcgggctggcaaggc

SEQ ID NO: 653 - DNA, 495 bp, Artificial Sequence
  Oligonucleotide
gcctccctcgcgccatcagcgttacttaggtctcactggattccagcccctttttgcaagttcccagctgtccagccttgacttactcacctacaacagtgagccaacttccctctccaaaatatatggtgtttcgtcgaccgttacttaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagcgttacttaggtctcactgagcgggctggcaaggc

SEQ ID NO: 654 - DNA, 495 bp, Artificial Sequence
  Oligonucleotide
gcctccctcgcgccatcagtaggagacaggtctcactcctggaactccgaccttatgatacactatcccgaaagaagtcttttacatacccaagacagagagctgggttccactgccaaaaaacagtttttcattgtcgactaggagacaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagtaggagacaggtctcactgagcgggctggcaaggc

SEQ ID NO: 655 - DNA, 495 bp, Artificial Sequence
  Oligonucleotide
gcctccctcgcgccatcaggacactctaggtctcaagagaactctgccttcaagggacaatggccataccaccctgattctgcaacttacctaggatggagagtcgagtcccatcaccaaaatgctggggctgatgtcgacgacactctaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaaggacactctaggtctcactgagcgggctggcaaggc

SEQ ID NO: 656 - DNA, 495 bp, Artificial Sequence
  Oligonucleotide
gcctccctcgcgccatcagttcggaacaggtctcaatcattgcagtcaaacccaggcacccccgagtcaagagtggagcccccatacctgtcacagtgagcctggtcccgttcccaaagtggaggggtgaattatgtcgacttcggaacaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagttcggaacaggtctcactgagcgggctggcaaggc

SEQ ID NO: 657 - DNA, 495 bp, Artificial Sequence
  Oligonucleotide
gcctccctcgcgccatcagaagtaacgaggtctcagggtcgtgcaggctgggctgctcaccctctctcccacctggagcccccttcttacctagcacggtgagccgtgtccctggcccgaagaactgctcattgtgtcgacaagtaacgaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagaagtaacgaggtctcactgagcgggctggcaaggc

SEQ ID NO: 658 - DNA, 495 bp, Artificial Sequence
  Oligonucleotide
gcctccctcgcgccatcaggtctcctaaggtctcacctctgcccatcccgccctctcggagctctccggagccccaaccgcctccttacccagtacggtcagcctagagccttctccaaaaaacagctccccggtgtcgacgtctcctaaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaaggtctcctaaggtctcactgagcgggctggcaaggc

SEQ ID NO: 659 - DNA, 495 bp, Artificial Sequence
  Oligonucleotide
gcctccctcgcgccatcaggtagacacaggtctcagcgtcccggggcgccccctccccagttccggggcttcagcgggagcccccgcttaccgagcactgtcagccgggtgcctgggccaaaatactgcgtatctgtcgacgtagacacaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaaggtagacacaggtctcactgagcgggctggcaaggc

SEQ ID NO: 660 - DNA, 495 bp, Artificial Sequence
  Oligonucleotide
gcctccctcgcgccatcagcactgtacaggtctcacgcacaaaaacccgagcgcagtctcgtccccggtcccccggcggccccagcttacccagcactgagagccgggtcccggcgccgaagtactgaatgttttgtcgaccactgtacaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagcactgtacaggtctcactgagcgggctggcaaggc

SEQ ID NO: 661 - DNA, 495 bp, Artificial Sequence
  Oligonucleotide
gcctccctcgcgccatcaggatgatccaggtctcaccccgcaaaaaccagacccaagccgcccgcgcccgcgccccagcagcccgcgctcaccgagcaccaggagccgcgtgcctggcccgaagtactgggtctcgtcgacgatgatccaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaaggatgatccaggtctcactgagcgggctggcaaggc

SEQ ID NO: 662 - DNA, 495 bp, Artificial Sequence
  Oligonucleotide
gcctccctcgcgccatcagcgccaataaggtctcaccgccgccttccacctgaatcccgccgcccgggtggtcccgcgaaaactcacccagcacggtcagcctgctgccggccccgaaagtcaggacgttggcccgtcgaccgccaataaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagcgccaataaggtctcactgagcgggctggcaaggc

SEQ ID NO: 663 - DNA, 495 bp, Artificial Sequence
  Oligonucleotide
gcctccctcgcgccatcagtcaagcctaggtctcaccaccctccgactccggggaccgaggggctggaaggtggggagacgcccgaatctcacctgtgaccgtgagcctggtgcccggcccgaagtactgctcgtgtcgactcaagcctaggtctcatcactgctggcacaaaaatacactgctgaatcctcaagcttcgtagcctggatctcaaggctacagggtgaatttgggaggcacttagctgaaaatctttccttgggcatacctgtttcatcaaagacattttcattctggaaggaaatcaagaacttgaactcgtttttcaggacctgttggtaccaaaaaacataactgtgtccttttattggggcacaatataattttgctttctgtccttcccctctgacaagatgttttggagtctgggcgacttcttcaccaggagaacctgtaaagtcaagcctaggtctcactgagcgggctggcaaggc

SEQ ID NO: 664 - DNA, 495 bp, Artificial Sequence
  Oligonucleotide
gcctccctcgcgccatcagagagtgtcgtccattcctgtggacccacttttccctgtgacggatctgcaaaagaacctgaaaaatgtcttacctacaactgtgagtctggtgccttgtccaaagaaagcttcagtgtcgacagagtgtcgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaaagagtgtcgtccattcctgagcgggctggcaaggc

SEQ ID NO: 665 - DNA, 495 bp, Artificial Sequence
  Oligonucleotide
gcctccctcgcgccatcaggttccgaagtccattcatttcccaggacagagtcctccctcatcgcacccctcctagagacccccagccttacctacaacggttaacctggtccccgaaccgaaggtgtagccatagtcgacgttccgaagtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaagttccgaagtccattcctgagcgggctggcaaggc

SEQ ID NO: 666 - DNA, 495 bp, Artificial Sequence
  Oligonucleotide
gcctccctcgcgccatcagcgttacttgtccattcctggattccagcccctttttgcaagttcccagctgtccagccttgacttactcacctacaacagtgagccaacttccctctccaaaatatatggtgtttcgtcgaccgttacttgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaacgttacttgtccattcctgagcgggctggcaaggc

SEQ ID NO: 667 - DNA, 495 bp, Artificial Sequence
  Oligonucleotide
gcctccctcgcgccatcagtaggagacgtccattcctcctggaactccgaccttatgatacactatcccgaaagaagtcttttacatacccaagacagagagctgggttccactgccaaaaaacagtttttcattgtcgactaggagacgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaataggagacgtccattcctgagcgggctggcaaggc

SEQ ID NO: 668 - DNA, 495 bp, Artificial Sequence
  Oligonucleotide
gcctccctcgcgccatcaggacactctgtccattcagagaactctgccttcaagggacaatggccataccaccctgattctgcaacttacctaggatggagagtcgagtcccatcaccaaaatgctggggctgatgtcgacgacactctgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaagacactctgtccattcctgagcgggctggcaaggc

SEQ ID NO: 669 - DNA, 495 bp, Artificial Sequence
  Oligonucleotide
gcctccctcgcgccatcagttcggaacgtccattcatcattgcagtcaaacccaggcacccccgagtcaagagtggagcccccatacctgtcacagtgagcctggtcccgttcccaaagtggaggggtgaattatgtcgacttcggaacgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaattcggaacgtccattcctgagcgggctggcaaggc

SEQ ID NO: 670 - DNA, 495 bp, Artificial Sequence
  Oligonucleotide
gcctccctcgcgccatcagaagtaacggtccattcgggtcgtgcaggctgggctgctcaccctctctcccacctggagcccccttcttacctagcacggtgagccgtgtccctggcccgaagaactgctcattgtgtcgacaagtaacggtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaaaagtaacggtccattcctgagcgggctggcaaggc

SEQ ID NO: 671 - DNA, 495 bp, Artificial Sequence
  Oligonucleotide
gcctccctcgcgccatcaggtctcctagtccattccctctgcccatcccgccctctcggagctctccggagccccaaccgcctccttacccagtacggtcagcctagagccttctccaaaaaacagctccccggtgtcgacgtctcctagtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaagtctcctagtccattcctgagcgggctggcaaggc

SEQ ID NO: 672 - DNA, 495 bp, Artificial Sequence
  Oligonucleotide
gcctccctcgcgccatcaggtagacacgtccattcgcgtcccggggcgccccctccccagttccggggcttcagcgggagcccccgcttaccgagcactgtcagccgggtgcctgggccaaaatactgcgtatctgtcgacgtagacacgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaagtagacacgtccattcctgagcgggctggcaaggc

SEQ ID NO: 673 - DNA, 495 bp, Artificial Sequence
  Oligonucleotide
gcctccctcgcgccatcagcactgtacgtccattccgcacaaaaacccgagcgcagtctcgtccccggtcccccggcggccccagcttacccagcactgagagccgggtcccggcgccgaagtactgaatgttttgtcgaccactgtacgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaacactgtacgtccattcctgagcgggctggcaaggc

SEQ ID NO: 674 - DNA, 495 bp, Artificial Sequence
  Oligonucleotide
gcctccctcgcgccatcaggatgatccgtccattcccccgcaaaaaccagacccaagccgcccgcgcccgcgccccagcagcccgcgctcaccgagcaccaggagccgcgtgcctggcccgaagtactgggtctcgtcgacgatgatccgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaagatgatccgtccattcctgagcgggctggcaaggc

SEQ ID NO: 675 - DNA, 495 bp, Artificial Sequence
  Oligonucleotide
gcctccctcgcgccatcagcgccaatagtccattcccgccgccttccacctgaatcccgccgcccgggtggtcccgcgaaaactcacccagcacggtcagcctgctgccggccccgaaagtcaggacgttggcccgtcgaccgccaatagtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaacgccaatagtccattcctgagcgggctggcaaggc

SEQ ID NO: 676 - DNA, 495 bp, Artificial Sequence
  Oligonucleotide
gcctccctcgcgccatcagtcaagcctgtccattcccaccctccgactccggggaccgaggggctggaaggtggggagacgcccgaatctcacctgtgaccgtgagcctggtgcccggcccgaagtactgctcgtgtcgactcaagcctgtccattctcactactgtagagatacacggctgagtccctcggctctgcgggatggatcttcagcgtggaagacgttccgttaggtctttcagctgtgaatcgttccttgggcatccctgaatcaactgcaatgttttggtactggaaggaaatcagcaacttcatttcttgcctcagattctgtcggtaccagtgaacaaacatgtgaccagaagatggatcgcacctcagaatcacctcctgtcccatgttggtgaccttgtgtctgggggtctggctgactccaggctccgagtgtcctgtggaagaatcaagcctgtccattcctgagcgggctggcaaggc

SEQ ID NO: 677 - DNA, 495 bp, Artificial Sequence
  Oligonucleotide
gcctccctcgcgccatcagagagtgtcgcataactctgtggacccacttttccctgtgacggatctgcaaaagaacctgaaaaatgtcttacctacaactgtgagtctggtgccttgtccaaagaaagcttcagtgtcgacagagtgtcgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggagagtgtcgcataactctgagcgggctggcaaggc

SEQ ID NO: 678 - DNA, 495 bp, Artificial Sequence
  Oligonucleotide
gcctccctcgcgccatcaggttccgaagcataactatttcccaggacagagtcctccctcatcgcacccctcctagagacccccagccttacctacaacggttaacctggtccccgaaccgaaggtgtagccatagtcgacgttccgaagcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagagggttccgaagcataactctgagcgggctggcaaggc

SEQ ID NO: 679 - DNA, 495 bp, Artificial Sequence
  Oligonucleotide
gcctccctcgcgccatcagcgttacttgcataactctggattccagcccctttttgcaagttcccagctgtccagccttgacttactcacctacaacagtgagccaacttccctctccaaaatatatggtgtttcgtcgaccgttacttgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggcgttacttgcataactctgagcgggctggcaaggc

SEQ ID NO: 680 - DNA, 495 bp, Artificial Sequence
  Oligonucleotide
gcctccctcgcgccatcagtaggagacgcataactctcctggaactccgaccttatgatacactatcccgaaagaagtcttttacatacccaagacagagagctgggttccactgccaaaaaacagtttttcattgtcgactaggagacgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggtaggagacgcataactctgagcgggctggcaaggc

SEQ ID NO: 681 - DNA, 495 bp, Artificial Sequence
  Oligonucleotide
gcctccctcgcgccatcaggacactctgcataactagagaactctgccttcaagggacaatggccataccaccctgattctgcaacttacctaggatggagagtcgagtcccatcaccaaaatgctggggctgatgtcgacgacactctgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagagggacactctgcataactctgagcgggctggcaaggc

SEQ ID NO: 682 - DNA, 495 bp, Artificial Sequence
  Oligonucleotide
gcctccctcgcgccatcagttcggaacgcataactatcattgcagtcaaacccaggcacccccgagtcaagagtggagcccccatacctgtcacagtgagcctggtcccgttcccaaagtggaggggtgaattatgtcgacttcggaacgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggttcggaacgcataactctgagcgggctggcaaggc

SEQ ID NO: 683 - DNA, 495 bp, Artificial Sequence
  Oligonucleotide
gcctccctcgcgccatcagaagtaacggcataactgggtcgtgcaggctgggctgctcaccctctctcccacctggagcccccttcttacctagcacggtgagccgtgtccctggcccgaagaactgctcattgtgtcgacaagtaacggcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggaagtaacggcataactctgagcgggctggcaaggc

SEQ ID NO: 684 - DNA, 495 bp, Artificial Sequence
  Oligonucleotide
gcctccctcgcgccatcaggtctcctagcataactcctctgcccatcccgccctctcggagctctccggagccccaaccgcctccttacccagtacggtcagcctagagccttctccaaaaaacagctccccggtgtcgacgtctcctagcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagagggtctcctagcataactctgagcgggctggcaaggc

SEQ ID NO: 685 - DNA, 495 bp, Artificial Sequence
  Oligonucleotide
gcctccctcgcgccatcaggtagacacgcataactgcgtcccggggcgccccctccccagttccggggcttcagcgggagcccccgcttaccgagcactgtcagccgggtgcctgggccaaaatactgcgtatctgtcgacgtagacacgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagagggtagacacgcataactctgagcgggctggcaaggc

SEQ ID NO: 686 - DNA, 495 bp, Artificial Sequence
  Oligonucleotide
gcctccctcgcgccatcagcactgtacgcataactcgcacaaaaacccgagcgcagtctcgtccccggtcccccggcggccccagcttacccagcactgagagccgggtcccggcgccgaagtactgaatgttttgtcgaccactgtacgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggcactgtacgcataactctgagcgggctggcaaggc

SEQ ID NO: 687 - DNA, 495 bp, Artificial Sequence
  Oligonucleotide
gcctccctcgcgccatcaggatgatccgcataactccccgcaaaaaccagacccaagccgcccgcgcccgcgccccagcagcccgcgctcaccgagcaccaggagccgcgtgcctggcccgaagtactgggtctcgtcgacgatgatccgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagagggatgatccgcataactctgagcgggctggcaaggc

SEQ ID NO: 688 - DNA, 495 bp, Artificial Sequence
  Oligonucleotide
gcctccctcgcgccatcagcgccaatagcataactccgccgccttccacctgaatcccgccgcccgggtggtcccgcgaaaactcacccagcacggtcagcctgctgccggccccgaaagtcaggacgttggcccgtcgaccgccaatagcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggcgccaatagcataactctgagcgggctggcaaggc

SEQ ID NO: 689 - DNA, 495 bp, Artificial Sequence
  Oligonucleotide
gcctccctcgcgccatcagtcaagcctgcataactccaccctccgactccggggaccgaggggctggaaggtggggagacgcccgaatctcacctgtgaccgtgagcctggtgcccggcccgaagtactgctcgtgtcgactcaagcctgcataacttcagagctggcacagaaataagctgccgaatctcctcgcactacctgctggatcctcaggatgctggggccctctttgggaaattcagcagaaaatcgttcctttggcattcctgactcatctatgatattttctttctggagataaaccatgaatttcagaccttcctctgggagctgccgataccagtaaacatgactgtgtcctttcattgggctgcatctcagtcttgcctcctgtcccctcctcctgaccaggtgtcttgggttctgcatgacgccggcatttgagagacctcagaggtcaagcctgcataactctgagcgggctggcaaggc

SEQ ID NO: 690 - DNA, 495 bp, Artificial Sequence
  Oligonucleotide
gcctccctcgcgccatcagagagtgtcatatgctgctgtggacccacttttccctgtgacggatctgcaaaagaacctgaaaaatgtcttacctacaactgtgagtctggtgccttgtccaaagaaagcttcagtgtcgacagagtgtcatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaaagagtgtcatatgctgctgagcgggctggcaaggc

SEQ ID NO: 691 - DNA, 495 bp, Artificial Sequence
  Oligonucleotide
gcctccctcgcgccatcaggttccgaaatatgctgatttcccaggacagagtcctccctcatcgcacccctcctagagacccccagccttacctacaacggttaacctggtccccgaaccgaaggtgtagccatagtcgacgttccgaaatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaagttccgaaatatgctgctgagcgggctggcaaggc

SEQ ID NO: 692 - DNA, 495 bp, Artificial Sequence
  Oligonucleotide
gcctccctcgcgccatcagcgttacttatatgctgctggattccagcccctttttgcaagttcccagctgtccagccttgacttactcacctacaacagtgagccaacttccctctccaaaatatatggtgtttcgtcgaccgttacttatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaacgttacttatatgctgctgagcgggctggcaaggc

SEQ ID NO: 693 - DNA, 495 bp, Artificial Sequence
  Oligonucleotide
gcctccctcgcgccatcagtaggagacatatgctgctcctggaactccgaccttatgatacactatcccgaaagaagtcttttacatacccaagacagagagctgggttccactgccaaaaaacagtttttcattgtcgactaggagacatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaataggagacatatgctgctgagcgggctggcaaggc

SEQ ID NO: 694 - DNA, 495 bp, Artificial Sequence
  Oligonucleotide
gcctccctcgcgccatcaggacactctatatgctgagagaactctgccttcaagggacaatggccataccaccctgattctgcaacttacctaggatggagagtcgagtcccatcaccaaaatgctggggctgatgtcgacgacactctatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaagacactctatatgctgctgagcgggctggcaaggc

SEQ ID NO: 695 - DNA, 495 bp, Artificial Sequence
  Oligonucleotide
gcctccctcgcgccatcagttcggaacatatgctgatcattgcagtcaaacccaggcacccccgagtcaagagtggagcccccatacctgtcacagtgagcctggtcccgttcccaaagtggaggggtgaattatgtcgacttcggaacatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaattcggaacatatgctgctgagcgggctggcaaggc

SEQ ID NO: 696 - DNA, 495 bp, Artificial Sequence
  Oligonucleotide
gcctccctcgcgccatcagaagtaacgatatgctggggtcgtgcaggctgggctgctcaccctctctcccacctggagcccccttcttacctagcacggtgagccgtgtccctggcccgaagaactgctcattgtgtcgacaagtaacgatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaaaagtaacgatatgctgctgagcgggctggcaaggc

SEQ ID NO: 697 - DNA, 495 bp, Artificial Sequence
  Oligonucleotide
gcctccctcgcgccatcaggtctcctaatatgctgcctctgcccatcccgccctctcggagctctccggagccccaaccgcctccttacccagtacggtcagcctagagccttctccaaaaaacagctccccggtgtcgacgtctcctaatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaagtctcctaatatgctgctgagcgggctggcaaggc

SEQ ID NO: 698 - DNA, 495 bp, Artificial Sequence
  Oligonucleotide
gcctccctcgcgccatcaggtagacacatatgctggcgtcccggggcgccccctccccagttccggggcttcagcgggagcccccgcttaccgagcactgtcagccgggtgcctgggccaaaatactgcgtatctgtcgacgtagacacatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaagtagacacatatgctgctgagcgggctggcaaggc

SEQ ID NO: 699 - DNA, 495 bp, Artificial Sequence
  Oligonucleotide
gcctccctcgcgccatcagcactgtacatatgctgcgcacaaaaacccgagcgcagtctcgtccccggtcccccggcggccccagcttacccagcactgagagccgggtcccggcgccgaagtactgaatgttttgtcgaccactgtacatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaacactgtacatatgctgctgagcgggctggcaaggc

SEQ ID NO: 700 - DNA, 495 bp, Artificial Sequence
  Oligonucleotide
gcctccctcgcgccatcaggatgatccatatgctgccccgcaaaaaccagacccaagccgcccgcgcccgcgccccagcagcccgcgctcaccgagcaccaggagccgcgtgcctggcccgaagtactgggtctcgtcgacgatgatccatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaagatgatccatatgctgctgagcgggctggcaaggc

SEQ ID NO: 701 - DNA, 495 bp, Artificial Sequence
  Oligonucleotide
gcctccctcgcgccatcagcgccaataatatgctgccgccgccttccacctgaatcccgccgcccgggtggtcccgcgaaaactcacccagcacggtcagcctgctgccggccccgaaagtcaggacgttggcccgtcgaccgccaataatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaacgccaataatatgctgctgagcgggctggcaaggc

SEQ ID NO: 702 - DNA, 495 bp, Artificial Sequence
  Oligonucleotide
gcctccctcgcgccatcagtcaagcctatatgctgccaccctccgactccggggaccgaggggctggaaggtggggagacgcccgaatctcacctgtgaccgtgagcctggtgcccggcccgaagtactgctcgtgtcgactcaagcctatatgctgtcactactggcacagagatagaaagctgtcgggttcttttgggccgatgtcacagtgagaggaaaggattccttcttctcccgagagacgctgtacccttcagctatatctcctttctgaaagtcatttactatctgtgagtagtagatcaatctcagcccttgccctgggtcctgtcggtaccagtacatggcatcgtggttcaaattctgttcacaactcagggtcacattctgtccttcctttctgaacaggtactttggggactgagtgattccaccatccacggtgtctggaaaagaatcaagcctatatgctgctgagcgggctggcaaggc

SEQ ID NO: 703 - DNA, 495 bp, Artificial Sequence
  Oligonucleotide
gcctccctcgcgccatcagagagtgtcaatcctgcctgtggacccacttttccctgtgacggatctgcaaaagaacctgaaaaatgtcttacctacaactgtgagtctggtgccttgtccaaagaaagcttcagtgtcgacagagtgtcaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctagagtgtcaatcctgcctgagcgggctggcaaggc

SEQ ID NO: 704 - DNA, 495 bp, Artificial Sequence
  Oligonucleotide
gcctccctcgcgccatcaggttccgaaaatcctgcatttcccaggacagagtcctccctcatcgcacccctcctagagacccccagccttacctacaacggttaacctggtccccgaaccgaaggtgtagccatagtcgacgttccgaaaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctgttccgaaaatcctgcctgagcgggctggcaaggc

SEQ ID NO: 705 - DNA, 495 bp, Artificial Sequence
  Oligonucleotide
gcctccctcgcgccatcagcgttacttaatcctgcctggattccagcccctttttgcaagttcccagctgtccagccttgacttactcacctacaacagtgagccaacttccctctccaaaatatatggtgtttcgtcgaccgttacttaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctcgttacttaatcctgcctgagcgggctggcaaggc

SEQ ID NO: 706 - DNA, 495 bp, Artificial Sequence
  Oligonucleotide
gcctccctcgcgccatcagtaggagacaatcctgcctcctggaactccgaccttatgatacactatcccgaaagaagtcttttacatacccaagacagagagctgggttccactgccaaaaaacagtttttcattgtcgactaggagacaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagccttaggagacaatcctgcctgagcgggctggcaaggc

SEQ ID NO: 707 - DNA, 495 bp, Artificial Sequence
  Oligonucleotide
gcctccctcgcgccatcaggacactctaatcctgcagagaactctgccttcaagggacaatggccataccaccctgattctgcaacttacctaggatggagagtcgagtcccatcaccaaaatgctggggctgatgtcgacgacactctaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctgacactctaatcctgcctgagcgggctggcaaggc

SEQ ID NO: 708 - DNA, 495 bp, Artificial Sequence
  Oligonucleotide
gcctccctcgcgccatcagttcggaacaatcctgcatcattgcagtcaaacccaggcacccccgagtcaagagtggagcccccatacctgtcacagtgagcctggtcccgttcccaaagtggaggggtgaattatgtcgacttcggaacaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctttcggaacaatcctgcctgagcgggctggcaaggc

SEQ ID NO: 709 - DNA, 495 bp, Artificial Sequence
  Oligonucleotide
gcctccctcgcgccatcagaagtaacgaatcctgcgggtcgtgcaggctgggctgctcaccctctctcccacctggagcccccttcttacctagcacggtgagccgtgtccctggcccgaagaactgctcattgtgtcgacaagtaacgaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctaagtaacgaatcctgcctgagcgggctggcaaggc

SEQ ID NO: 710 - DNA, 495 bp, Artificial Sequence
  Oligonucleotide
gcctccctcgcgccatcaggtctcctaaatcctgccctctgcccatcccgccctctcggagctctccggagccccaaccgcctccttacccagtacggtcagcctagagccttctccaaaaaacagctccccggtgtcgacgtctcctaaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctgtctcctaaatcctgcctgagcgggctggcaaggc

SEQ ID NO: 711 - DNA, 495 bp, Artificial Sequence
  Oligonucleotide
gcctccctcgcgccatcaggtagacacaatcctgcgcgtcccggggcgccccctccccagttccggggcttcagcgggagcccccgcttaccgagcactgtcagccgggtgcctgggccaaaatactgcgtatctgtcgacgtagacacaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctgtagacacaatcctgcctgagcgggctggcaaggc

SEQ ID NO: 712 - DNA, 495 bp, Artificial Sequence
  Oligonucleotide
gcctccctcgcgccatcagcactgtacaatcctgccgcacaaaaacccgagcgcagtctcgtccccggtcccccggcggccccagcttacccagcactgagagccgggtcccggcgccgaagtactgaatgttttgtcgaccactgtacaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctcactgtacaatcctgcctgagcgggctggcaaggc

SEQ ID NO: 713 - DNA, 495 bp, Artificial Sequence
  Oligonucleotide
gcctccctcgcgccatcaggatgatccaatcctgcccccgcaaaaaccagacccaagccgcccgcgcccgcgccccagcagcccgcgctcaccgagcaccaggagccgcgtgcctggcccgaagtactgggtctcgtcgacgatgatccaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctgatgatccaatcctgcctgagcgggctggcaaggc

SEQ ID NO: 714 - DNA, 495 bp, Artificial Sequence
  Oligonucleotide
gcctccctcgcgccatcagcgccaataaatcctgcccgccgccttccacctgaatcccgccgcccgggtggtcccgcgaaaactcacccagcacggtcagcctgctgccggccccgaaagtcaggacgttggcccgtcgaccgccaataaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagcctcgccaataaatcctgcctgagcgggctggcaaggc

SEQ ID NO: 715 - DNA, 495 bp, Artificial Sequence
  Oligonucleotide
gcctccctcgcgccatcagtcaagcctaatcctgcccaccctccgactccggggaccgaggggctggaaggtggggagacgcccgaatctcacctgtgaccgtgagcctggtgcccggcccgaagtactgctcgtgtcgactcaagcctaatcctgctcagcactgcagatgtagaagctgctgtcttcaggatgggcactggtcactgtcagagtggacaaggtcaggcttgcatggttgatgagaaacttgtccttctcgacgccttgctcgtatgtggccttggagccctcattggaagttgccatcagcatgagactctgtttcgggaactgacgataccaaaacatagttgtggcctgaaagtccagggaacggcactcgatcttcacagaggttccactcttacagataacccagctcggatgttgagagacgacagcaccaagcccggagccttcaagcctaatcctgcctgagcgggctggcaaggc

SEQ ID NO: 716 - DNA, 495 bp, Artificial Sequence
  Oligonucleotide
gcctccctcgcgccatcagagagtgtctgagacctctgtggacccacttttccctgtgacggatctgcaaaagaacctgaaaaatgtcttacctacaactgtgagtctggtgccttgtccaaagaaagcttcagtgtcgacagagtgtctgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagagagtgtctgagacctctgagcgggctggcaaggc

SEQ ID NO: 717 - DNA, 495 bp, Artificial Sequence
  Oligonucleotide
gcctccctcgcgccatcaggttccgaatgagacctatttcccaggacagagtcctccctcatcgcacccctcctagagacccccagccttacctacaacggttaacctggtccccgaaccgaaggtgtagccatagtcgacgttccgaatgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggaggttccgaatgagacctctgagcgggctggcaaggc

SEQ ID NO: 718 - DNA, 495 bp, Artificial Sequence
  Oligonucleotide
gcctccctcgcgccatcagcgttactttgagacctctggattccagcccctttttgcaagttcccagctgtccagccttgacttactcacctacaacagtgagccaacttccctctccaaaatatatggtgtttcgtcgaccgttactttgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagcgttactttgagacctctgagcgggctggcaaggc

SEQ ID NO: 719 - DNA, 495 bp, Artificial Sequence
  Oligonucleotide
gcctccctcgcgccatcagtaggagactgagacctctcctggaactccgaccttatgatacactatcccgaaagaagtcttttacatacccaagacagagagctgggttccactgccaaaaaacagtttttcattgtcgactaggagactgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagtaggagactgagacctctgagcgggctggcaaggc

SEQ ID NO: 720 - DNA, 495 bp, Artificial Sequence
  Oligonucleotide
gcctccctcgcgccatcaggacactcttgagacctagagaactctgccttcaagggacaatggccataccaccctgattctgcaacttacctaggatggagagtcgagtcccatcaccaaaatgctggggctgatgtcgacgacactcttgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggaggacactcttgagacctctgagcgggctggcaaggc

SEQ ID NO: 721 - DNA, 495 bp, Artificial Sequence
  Oligonucleotide
gcctccctcgcgccatcagttcggaactgagacctatcattgcagtcaaacccaggcacccccgagtcaagagtggagcccccatacctgtcacagtgagcctggtcccgttcccaaagtggaggggtgaattatgtcgacttcggaactgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagttcggaactgagacctctgagcgggctggcaaggc

SEQ ID NO: 722 - DNA, 495 bp, Artificial Sequence
  Oligonucleotide
gcctccctcgcgccatcagaagtaacgtgagacctgggtcgtgcaggctgggctgctcaccctctctcccacctggagcccccttcttacctagcacggtgagccgtgtccctggcccgaagaactgctcattgtgtcgacaagtaacgtgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagaagtaacgtgagacctctgagcgggctggcaaggc

SEQ ID NO: 723 - DNA, 495 bp, Artificial Sequence
  Oligonucleotide
gcctccctcgcgccatcaggtctcctatgagacctcctctgcccatcccgccctctcggagctctccggagccccaaccgcctccttacccagtacggtcagcctagagccttctccaaaaaacagctccccggtgtcgacgtctcctatgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggaggtctcctatgagacctctgagcgggctggcaaggc

SEQ ID NO: 724 - DNA, 495 bp, Artificial Sequence
  Oligonucleotide
gcctccctcgcgccatcaggtagacactgagacctgcgtcccggggcgccccctccccagttccggggcttcagcgggagcccccgcttaccgagcactgtcagccgggtgcctgggccaaaatactgcgtatctgtcgacgtagacactgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggaggtagacactgagacctctgagcgggctggcaaggc

SEQ ID NO: 725 - DNA, 495 bp, Artificial Sequence
  Oligonucleotide
gcctccctcgcgccatcagcactgtactgagacctcgcacaaaaacccgagcgcagtctcgtccccggtcccccggcggccccagcttacccagcactgagagccgggtcccggcgccgaagtactgaatgttttgtcgaccactgtactgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagcactgtactgagacctctgagcgggctggcaaggc

SEQ ID NO: 726 - DNA, 495 bp, Artificial Sequence
  Oligonucleotide
gcctccctcgcgccatcaggatgatcctgagacctccccgcaaaaaccagacccaagccgcccgcgcccgcgccccagcagcccgcgctcaccgagcaccaggagccgcgtgcctggcccgaagtactgggtctcgtcgacgatgatcctgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggaggatgatcctgagacctctgagcgggctggcaaggc

SEQ ID NO: 727 - DNA, 495 bp, Artificial Sequence
  Oligonucleotide
gcctccctcgcgccatcagcgccaatatgagacctccgccgccttccacctgaatcccgccgcccgggtggtcccgcgaaaactcacccagcacggtcagcctgctgccggccccgaaagtcaggacgttggcccgtcgaccgccaatatgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagcgccaatatgagacctctgagcgggctggcaaggc

SEQ ID NO: 728 - DNA, 495 bp, Artificial Sequence
  Oligonucleotide
gcctccctcgcgccatcagtcaagccttgagacctccaccctccgactccggggaccgaggggctggaaggtggggagacgcccgaatctcacctgtgaccgtgagcctggtgcccggcccgaagtactgctcgtgtcgactcaagccttgagaccttcactgctggcacagaaatacagtgctgtgtcccctgactccgtggactggatctccaaggtacaggatgagtttttggagcattgggctaaaaatcgctcattgattatttctgctttctgaataagttcttcattctgaaagtaaaccaaaaacttgagctcttcttccagcttcttacgataccagtaaacataactatgtgcttttataggaacacaatccatctttgctttctgttcacttgctttgaccagaagtctaggtctctgggtgaccttggtgtccgtggagcctgtggagtcaagccttgagacctctgagcgggctggcaaggc

SEQ ID NO: 729 - DNA, 495 bp, Artificial Sequence
  Oligonucleotide
gcctccctcgcgccatcagagagtgtcgaatggacctgtggacccacttttccctgtgacggatctgcaaaagaacctgaaaaatgtcttacctacaactgtgagtctggtgccttgtccaaagaaagcttcagtgtcgacagagtgtcgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaaagagtgtcgaatggacctgagcgggctggcaaggc

SEQ ID NO: 730 - DNA, 495 bp, Artificial Sequence
  Oligonucleotide
gcctccctcgcgccatcaggttccgaagaatggacatttcccaggacagagtcctccctcatcgcacccctcctagagacccccagccttacctacaacggttaacctggtccccgaaccgaaggtgtagccatagtcgacgttccgaagaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaagttccgaagaatggacctgagcgggctggcaaggc

SEQ ID NO: 731 - DNA, 495 bp, Artificial Sequence
  Oligonucleotide
gcctccctcgcgccatcagcgttacttgaatggacctggattccagcccctttttgcaagttcccagctgtccagccttgacttactcacctacaacagtgagccaacttccctctccaaaatatatggtgtttcgtcgaccgttacttgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaacgttacttgaatggacctgagcgggctggcaaggc

SEQ ID NO: 732 - DNA, 495 bp, Artificial Sequence
  Oligonucleotide
gcctccctcgcgccatcagtaggagacgaatggacctcctggaactccgaccttatgatacactatcccgaaagaagtcttttacatacccaagacagagagctgggttccactgccaaaaaacagtttttcattgtcgactaggagacgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaataggagacgaatggacctgagcgggctggcaaggc

SEQ ID NO: 733 - DNA, 495 bp, Artificial Sequence
  Oligonucleotide
gcctccctcgcgccatcaggacactctgaatggacagagaactctgccttcaagggacaatggccataccaccctgattctgcaacttacctaggatggagagtcgagtcccatcaccaaaatgctggggctgatgtcgacgacactctgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaagacactctgaatggacctgagcgggctggcaaggc

SEQ ID NO: 734 - DNA, 495 bp, Artificial Sequence
  Oligonucleotide
gcctccctcgcgccatcagttcggaacgaatggacatcattgcagtcaaacccaggcacccccgagtcaagagtggagcccccatacctgtcacagtgagcctggtcccgttcccaaagtggaggggtgaattatgtcgacttcggaacgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaattcggaacgaatggacctgagcgggctggcaaggc

SEQ ID NO: 735 - DNA, 495 bp, Artificial Sequence
  Oligonucleotide
gcctccctcgcgccatcagaagtaacggaatggacgggtcgtgcaggctgggctgctcaccctctctcccacctggagcccccttcttacctagcacggtgagccgtgtccctggcccgaagaactgctcattgtgtcgacaagtaacggaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaaaagtaacggaatggacctgagcgggctggcaaggc

SEQ ID NO: 736 - DNA, 495 bp, Artificial Sequence
  Oligonucleotide
gcctccctcgcgccatcaggtctcctagaatggaccctctgcccatcccgccctctcggagctctccggagccccaaccgcctccttacccagtacggtcagcctagagccttctccaaaaaacagctccccggtgtcgacgtctcctagaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaagtctcctagaatggacctgagcgggctggcaaggc

SEQ ID NO: 737 - DNA, 495 bp, Artificial Sequence
  Oligonucleotide
gcctccctcgcgccatcaggtagacacgaatggacgcgtcccggggcgccccctccccagttccggggcttcagcgggagcccccgcttaccgagcactgtcagccgggtgcctgggccaaaatactgcgtatctgtcgacgtagacacgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaagtagacacgaatggacctgagcgggctggcaaggc

SEQ ID NO: 738 - DNA, 495 bp, Artificial Sequence
  Oligonucleotide
gcctccctcgcgccatcagcactgtacgaatggaccgcacaaaaacccgagcgcagtctcgtccccggtcccccggcggccccagcttacccagcactgagagccgggtcccggcgccgaagtactgaatgttttgtcgaccactgtacgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaacactgtacgaatggacctgagcgggctggcaaggc

SEQ ID NO: 739 - DNA, 495 bp, Artificial Sequence
  Oligonucleotide
gcctccctcgcgccatcaggatgatccgaatggacccccgcaaaaaccagacccaagccgcccgcgcccgcgccccagcagcccgcgctcaccgagcaccaggagccgcgtgcctggcccgaagtactgggtctcgtcgacgatgatccgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaagatgatccgaatggacctgagcgggctggcaaggc

SEQ ID NO: 740 - DNA, 495 bp, Artificial Sequence
  Oligonucleotide
gcctccctcgcgccatcagcgccaatagaatggacccgccgccttccacctgaatcccgccgcccgggtggtcccgcgaaaactcacccagcacggtcagcctgctgccggccccgaaagtcaggacgttggcccgtcgaccgccaatagaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaacgccaatagaatggacctgagcgggctggcaaggc

SEQ ID NO: 741 - DNA, 495 bp, Artificial Sequence
  Oligonucleotide
gcctccctcgcgccatcagtcaagcctgaatggacccaccctccgactccggggaccgaggggctggaaggtggggagacgcccgaatctcacctgtgaccgtgagcctggtgcccggcccgaagtactgctcgtgtcgactcaagcctgaatggactcatcccaggacagaagtacaaagctgtttggctggtgtgggccaacttcaccctgagaagaaatagccccttctcctcttggcagacacgtagccttcagttagatctcctctctgaatatccttttcaacccttgagtaatagatcagtctcagattttgctttgggtcctgccagtaccagtagcagtacatgtcattgtgtctcaaattccgtttccactccagagtcacatcccatccagccccagtgagctggaatggcatctgatagatgtcagcatccaagggtccaagagacaatcaagcctgaatggacctgagcgggctggcaaggc

SEQ ID NO: 742 - DNA, 495 bp, Artificial Sequence
  Oligonucleotide
gcctccctcgcgccatcagagagtgtcgtcatagtctgtggacccacttttccctgtgacggatctgcaaaagaacctgaaaaatgtcttacctacaactgtgagtctggtgccttgtccaaagaaagcttcagtgtcgacagagtgtcgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagaagagtgtcgtcatagtctgagcgggctggcaaggc

SEQ ID NO: 743 - DNA, 495 bp, Artificial Sequence
  Oligonucleotide
gcctccctcgcgccatcaggttccgaagtcatagtatttcccaggacagagtcctccctcatcgcacccctcctagagacccccagccttacctacaacggttaacctggtccccgaaccgaaggtgtagccatagtcgacgttccgaagtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagagttccgaagtcatagtctgagcgggctggcaaggc

SEQ ID NO: 744 - DNA, 495 bp, Artificial Sequence
  Oligonucleotide
gcctccctcgcgccatcagcgttacttgtcatagtctggattccagcccctttttgcaagttcccagctgtccagccttgacttactcacctacaacagtgagccaacttccctctccaaaatatatggtgtttcgtcgaccgttacttgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagacgttacttgtcatagtctgagcgggctggcaaggc

SEQ ID NO: 745 - DNA, 495 bp, Artificial Sequence
  Oligonucleotide
gcctccctcgcgccatcagtaggagacgtcatagtctcctggaactccgaccttatgatacactatcccgaaagaagtcttttacatacccaagacagagagctgggttccactgccaaaaaacagtttttcattgtcgactaggagacgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagataggagacgtcatagtctgagcgggctggcaaggc

SEQ ID NO: 746 - DNA, 495 bp, Artificial Sequence
  Oligonucleotide
gcctccctcgcgccatcaggacactctgtcatagtagagaactctgccttcaagggacaatggccataccaccctgattctgcaacttacctaggatggagagtcgagtcccatcaccaaaatgctggggctgatgtcgacgacactctgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagagacactctgtcatagtctgagcgggctggcaaggc

SEQ ID NO: 747 - DNA, 495 bp, Artificial Sequence
  Oligonucleotide
gcctccctcgcgccatcagttcggaacgtcatagtatcattgcagtcaaacccaggcacccccgagtcaagagtggagcccccatacctgtcacagtgagcctggtcccgttcccaaagtggaggggtgaattatgtcgacttcggaacgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagattcggaacgtcatagtctgagcgggctggcaaggc

SEQ ID NO: 748 - DNA, 495 bp, Artificial Sequence
  Oligonucleotide
gcctccctcgcgccatcagaagtaacggtcatagtgggtcgtgcaggctgggctgctcaccctctctcccacctggagcccccttcttacctagcacggtgagccgtgtccctggcccgaagaactgctcattgtgtcgacaagtaacggtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagaaagtaacggtcatagtctgagcgggctggcaaggc

SEQ ID NO: 749 - DNA, 495 bp, Artificial Sequence
  Oligonucleotide
gcctccctcgcgccatcaggtctcctagtcatagtcctctgcccatcccgccctctcggagctctccggagccccaaccgcctccttacccagtacggtcagcctagagccttctccaaaaaacagctccccggtgtcgacgtctcctagtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagagtctcctagtcatagtctgagcgggctggcaaggc

SEQ ID NO: 750 - DNA, 495 bp, Artificial Sequence
  Oligonucleotide
gcctccctcgcgccatcaggtagacacgtcatagtgcgtcccggggcgccccctccccagttccggggcttcagcgggagcccccgcttaccgagcactgtcagccgggtgcctgggccaaaatactgcgtatctgtcgacgtagacacgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagagtagacacgtcatagtctgagcgggctggcaaggc

SEQ ID NO: 751 - DNA, 495 bp, Artificial Sequence
  Oligonucleotide
gcctccctcgcgccatcagcactgtacgtcatagtcgcacaaaaacccgagcgcagtctcgtccccggtcccccggcggccccagcttacccagcactgagagccgggtcccggcgccgaagtactgaatgttttgtcgaccactgtacgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagacactgtacgtcatagtctgagcgggctggcaaggc

SEQ ID NO: 752 - DNA, 495 bp, Artificial Sequence
  Oligonucleotide
gcctccctcgcgccatcaggatgatccgtcatagtccccgcaaaaaccagacccaagccgcccgcgcccgcgccccagcagcccgcgctcaccgagcaccaggagccgcgtgcctggcccgaagtactgggtctcgtcgacgatgatccgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagagatgatccgtcatagtctgagcgggctggcaaggc

SEQ ID NO: 753 - DNA, 495 bp, Artificial Sequence
  Oligonucleotide
gcctccctcgcgccatcagcgccaatagtcatagtccgccgccttccacctgaatcccgccgcccgggtggtcccgcgaaaactcacccagcacggtcagcctgctgccggccccgaaagtcaggacgttggcccgtcgaccgccaatagtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagacgccaatagtcatagtctgagcgggctggcaaggc

SEQ ID NO: 754 - DNA, 495 bp, Artificial Sequence
  Oligonucleotide
gcctccctcgcgccatcagtcaagcctgtcatagtccaccctccgactccggggaccgaggggctggaaggtggggagacgcccgaatctcacctgtgaccgtgagcctggtgcccggcccgaagtactgctcgtgtcgactcaagcctgtcatagttcactgctggcgcagagatacagtgccgtgtctcccggttctgaggacaggattgccaggctgcagggtgcgttcttggggcattgagatgagaatcgcttcttgtgcatctccgtttcttgaagaacttgttcattctgaaaggaaatcaaaagcataaactctttattctgattctgttgataccaataaacaaaagtatgtcctttttcgggggtacaatccatctttgttttctgtccttttcctttgaccaaatgtcctggagtctgtgtgactttggcatgaaaagagtctgtaagatcaagcctgtcatagtctgagcgggctggcaaggc

SEQ ID NO: 755 - DNA, 495 bp, Artificial Sequence
  Oligonucleotide
gcctccctcgcgccatcagagagtgtccacatggactgtggacccacttttccctgtgacggatctgcaaaagaacctgaaaaatgtcttacctacaactgtgagtctggtgccttgtccaaagaaagcttcagtgtcgacagagtgtccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatagagtgtccacatggactgagcgggctggcaaggc

SEQ ID NO: 756 - DNA, 495 bp, Artificial Sequence
  Oligonucleotide
gcctccctcgcgccatcaggttccgaacacatggaatttcccaggacagagtcctccctcatcgcacccctcctagagacccccagccttacctacaacggttaacctggtccccgaaccgaaggtgtagccatagtcgacgttccgaacacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatgttccgaacacatggactgagcgggctggcaaggc

SEQ ID NO: 757 - DNA, 495 bp, Artificial Sequence
  Oligonucleotide
gcctccctcgcgccatcagcgttacttcacatggactggattccagcccctttttgcaagttcccagctgtccagccttgacttactcacctacaacagtgagccaacttccctctccaaaatatatggtgtttcgtcgaccgttacttcacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatcgttacttcacatggactgagcgggctggcaaggc

SEQ ID NO: 758 - DNA, 495 bp, Artificial Sequence
  Oligonucleotide
gcctccctcgcgccatcagtaggagaccacatggactcctggaactccgaccttatgatacactatcccgaaagaagtcttttacatacccaagacagagagctgggttccactgccaaaaaacagtttttcattgtcgactaggagaccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaattaggagaccacatggactgagcgggctggcaaggc

SEQ ID NO: 759 - DNA, 495 bp, Artificial Sequence
  Oligonucleotide
gcctccctcgcgccatcaggacactctcacatggaagagaactctgccttcaagggacaatggccataccaccctgattctgcaacttacctaggatggagagtcgagtcccatcaccaaaatgctggggctgatgtcgacgacactctcacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatgacactctcacatggactgagcgggctggcaaggc

SEQ ID NO: 760 - DNA, 495 bp, Artificial Sequence
  Oligonucleotide
gcctccctcgcgccatcagttcggaaccacatggaatcattgcagtcaaacccaggcacccccgagtcaagagtggagcccccatacctgtcacagtgagcctggtcccgttcccaaagtggaggggtgaattatgtcgacttcggaaccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatttcggaaccacatggactgagcgggctggcaaggc

SEQ ID NO: 761 - DNA, 495 bp, Artificial Sequence
  Oligonucleotide
gcctccctcgcgccatcagaagtaacgcacatggagggtcgtgcaggctgggctgctcaccctctctcccacctggagcccccttcttacctagcacggtgagccgtgtccctggcccgaagaactgctcattgtgtcgacaagtaacgcacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaataagtaacgcacatggactgagcgggctggcaaggc

SEQ ID NO: 762 - DNA, 495 bp, Artificial Sequence
  Oligonucleotide
gcctccctcgcgccatcaggtctcctacacatggacctctgcccatcccgccctctcggagctctccggagccccaaccgcctccttacccagtacggtcagcctagagccttctccaaaaaacagctccccggtgtcgacgtctcctacacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatgtctcctacacatggactgagcgggctggcaaggc

SEQ ID NO: 763 - DNA, 495 bp, Artificial Sequence
  Oligonucleotide
gcctccctcgcgccatcaggtagacaccacatggagcgtcccggggcgccccctccccagttccggggcttcagcgggagcccccgcttaccgagcactgtcagccgggtgcctgggccaaaatactgcgtatctgtcgacgtagacaccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatgtagacaccacatggactgagcgggctggcaaggc

SEQ ID NO: 764 - DNA, 495 bp, Artificial Sequence
  Oligonucleotide
gcctccctcgcgccatcagcactgtaccacatggacgcacaaaaacccgagcgcagtctcgtccccggtcccccggcggccccagcttacccagcactgagagccgggtcccggcgccgaagtactgaatgttttgtcgaccactgtaccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatcactgtaccacatggactgagcgggctggcaaggc

SEQ ID NO: 765 - DNA, 495 bp, Artificial Sequence
  Oligonucleotide
gcctccctcgcgccatcaggatgatcccacatggaccccgcaaaaaccagacccaagccgcccgcgcccgcgccccagcagcccgcgctcaccgagcaccaggagccgcgtgcctggcccgaagtactgggtctcgtcgacgatgatcccacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatgatgatcccacatggactgagcgggctggcaaggc

SEQ ID NO: 766 - DNA, 495 bp, Artificial Sequence
  Oligonucleotide
gcctccctcgcgccatcagcgccaatacacatggaccgccgccttccacctgaatcccgccgcccgggtggtcccgcgaaaactcacccagcacggtcagcctgctgccggccccgaaagtcaggacgttggcccgtcgaccgccaatacacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaatcgccaatacacatggactgagcgggctggcaaggc

SEQ ID NO: 767 - DNA, 495 bp, Artificial Sequence
  Oligonucleotide
gcctccctcgcgccatcagtcaagcctcacatggaccaccctccgactccggggaccgaggggctggaaggtggggagacgcccgaatctcacctgtgaccgtgagcctggtgcccggcccgaagtactgctcgtgtcgactcaagcctcacatggatcaactggtggcacagaagtaaagagctgtctggttggggatggcagactctagggacagggagaatttagcctgtgcctgtcgagagacactgtatccatcagagatctctcctttgtttatatctttgacatcaaaggagtaatagatcaaccgtaggcccagtcctgggtcttgtcgataccagtacattctatcatgacccttagtctgagaacattccagcataatcctctttcctgtctttgtgatcctattccttggggtctgggtaacatcagcatccatggaccctgtggaaattcaagcctcacatggactgagcgggctggcaaggc

SEQ ID NO: 768 - DNA, 495 bp, Artificial Sequence
  Oligonucleotide
gcctccctcgcgccatcagagagtgtcttgaccatctgtggacccacttttccctgtgacggatctgcaaaagaacctgaaaaatgtcttacctacaactgtgagtctggtgccttgtccaaagaaagcttcagtgtcgacagagtgtcttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagaagagtgtcttgaccatctgagcgggctggcaaggc

SEQ ID NO: 769 - DNA, 495 bp, Artificial Sequence
  Oligonucleotide
gcctccctcgcgccatcaggttccgaattgaccatatttcccaggacagagtcctccctcatcgcacccctcctagagacccccagccttacctacaacggttaacctggtccccgaaccgaaggtgtagccatagtcgacgttccgaattgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagagttccgaattgaccatctgagcgggctggcaaggc

SEQ ID NO: 770 - DNA, 495 bp, Artificial Sequence
  Oligonucleotide
gcctccctcgcgccatcagcgttacttttgaccatctggattccagcccctttttgcaagttcccagctgtccagccttgacttactcacctacaacagtgagccaacttccctctccaaaatatatggtgtttcgtcgaccgttacttttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagacgttacttttgaccatctgagcgggctggcaaggc

SEQ ID NO: 771 - DNA, 495 bp, Artificial Sequence
  Oligonucleotide
gcctccctcgcgccatcagtaggagacttgaccatctcctggaactccgaccttatgatacactatcccgaaagaagtcttttacatacccaagacagagagctgggttccactgccaaaaaacagtttttcattgtcgactaggagacttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagataggagacttgaccatctgagcgggctggcaaggc

SEQ ID NO: 772 - DNA, 495 bp, Artificial Sequence
  Oligonucleotide
gcctccctcgcgccatcaggacactctttgaccatagagaactctgccttcaagggacaatggccataccaccctgattctgcaacttacctaggatggagagtcgagtcccatcaccaaaatgctggggctgatgtcgacgacactctttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagagacactctttgaccatctgagcgggctggcaaggc

SEQ ID NO: 773 - DNA, 495 bp, Artificial Sequence
  Oligonucleotide
gcctccctcgcgccatcagttcggaacttgaccatatcattgcagtcaaacccaggcacccccgagtcaagagtggagcccccatacctgtcacagtgagcctggtcccgttcccaaagtggaggggtgaattatgtcgacttcggaacttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagattcggaacttgaccatctgagcgggctggcaaggc

SEQ ID NO: 774 - DNA, 495 bp, Artificial Sequence
  Oligonucleotide
gcctccctcgcgccatcagaagtaacgttgaccatgggtcgtgcaggctgggctgctcaccctctctcccacctggagcccccttcttacctagcacggtgagccgtgtccctggcccgaagaactgctcattgtgtcgacaagtaacgttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagaaagtaacgttgaccatctgagcgggctggcaaggc

SEQ ID NO: 775 - DNA, 495 bp, Artificial Sequence
  Oligonucleotide
gcctccctcgcgccatcaggtctcctattgaccatcctctgcccatcccgccctctcggagctctccggagccccaaccgcctccttacccagtacggtcagcctagagccttctccaaaaaacagctccccggtgtcgacgtctcctattgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagagtctcctattgaccatctgagcgggctggcaaggc

SEQ ID NO: 776 - DNA, 495 bp, Artificial Sequence
  Oligonucleotide
gcctccctcgcgccatcaggtagacacttgaccatgcgtcccggggcgccccctccccagttccggggcttcagcgggagcccccgcttaccgagcactgtcagccgggtgcctgggccaaaatactgcgtatctgtcgacgtagacacttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagagtagacacttgaccatctgagcgggctggcaaggc

SEQ ID NO: 777 - DNA, 495 bp, Artificial Sequence
  Oligonucleotide
gcctccctcgcgccatcagcactgtacttgaccatcgcacaaaaacccgagcgcagtctcgtccccggtcccccggcggccccagcttacccagcactgagagccgggtcccggcgccgaagtactgaatgttttgtcgaccactgtacttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagacactgtacttgaccatctgagcgggctggcaaggc

SEQ ID NO: 778 - DNA, 495 bp, Artificial Sequence
  Oligonucleotide
gcctccctcgcgccatcaggatgatccttgaccatccccgcaaaaaccagacccaagccgcccgcgcccgcgccccagcagcccgcgctcaccgagcaccaggagccgcgtgcctggcccgaagtactgggtctcgtcgacgatgatccttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagagatgatccttgaccatctgagcgggctggcaaggc

SEQ ID NO: 779 - DNA, 495 bp, Artificial Sequence
  Oligonucleotide
gcctccctcgcgccatcagcgccaatattgaccatccgccgccttccacctgaatcccgccgcccgggtggtcccgcgaaaactcacccagcacggtcagcctgctgccggccccgaaagtcaggacgttggcccgtcgaccgccaatattgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagacgccaatattgaccatctgagcgggctggcaaggc

SEQ ID NO: 780 - DNA, 495 bp, Artificial Sequence
  Oligonucleotide
gcctccctcgcgccatcagtcaagcctttgaccatccaccctccgactccggggaccgaggggctggaaggtggggagacgcccgaatctcacctgtgaccgtgagcctggtgcccggcccgaagtactgctcgtgtcgactcaagcctttgaccattcactgctggcacagaggtactgagaggtatgtgagggcctggcagactccagggtcaggggaaaatgctccgtccttattctggagactgttgactcagaggaaagatctcccttctctgtggaattaactccataggaatagtggatgaggtgtagttccattcctggatcttgttgataccagtacattttgtcatggcccatggtttgagaacattccagagtgatcttctttcctgtccctataacaaggtatcttggggtctggtagatgtcagcttccatgaggcctatgggaagatcaagcctttgaccatctgagcgggctggcaaggc

SEQ ID NO: 781 - DNA, 495 bp, Artificial Sequence
  Oligonucleotide
gcctccctcgcgccatcagagagtgtcgtgacttgctgtggacccacttttccctgtgacggatctgcaaaagaacctgaaaaatgtcttacctacaactgtgagtctggtgccttgtccaaagaaagcttcagtgtcgacagagtgtcgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggagagtgtcgtgacttgctgagcgggctggcaaggc

SEQ ID NO: 782 - DNA, 495 bp, Artificial Sequence
  Oligonucleotide
gcctccctcgcgccatcaggttccgaagtgacttgatttcccaggacagagtcctccctcatcgcacccctcctagagacccccagccttacctacaacggttaacctggtccccgaaccgaaggtgtagccatagtcgacgttccgaagtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttgggggggttccgaagtgacttgctgagcgggctggcaaggc

SEQ ID NO: 783 - DNA, 495 bp, Artificial Sequence
  Oligonucleotide
gcctccctcgcgccatcagcgttacttgtgacttgctggattccagcccctttttgcaagttcccagctgtccagccttgacttactcacctacaacagtgagccaacttccctctccaaaatatatggtgtttcgtcgaccgttacttgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggcgttacttgtgacttgctgagcgggctggcaaggc

SEQ ID NO: 784 - DNA, 495 bp, Artificial Sequence
  Oligonucleotide
gcctccctcgcgccatcagtaggagacgtgacttgctcctggaactccgaccttatgatacactatcccgaaagaagtcttttacatacccaagacagagagctgggttccactgccaaaaaacagtttttcattgtcgactaggagacgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggtaggagacgtgacttgctgagcgggctggcaaggc

SEQ ID NO: 785 - DNA, 495 bp, Artificial Sequence
  Oligonucleotide
gcctccctcgcgccatcaggacactctgtgacttgagagaactctgccttcaagggacaatggccataccaccctgattctgcaacttacctaggatggagagtcgagtcccatcaccaaaatgctggggctgatgtcgacgacactctgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttgggggggacactctgtgacttgctgagcgggctggcaaggc

SEQ ID NO: 786 - DNA, 495 bp, Artificial Sequence
  Oligonucleotide
gcctccctcgcgccatcagttcggaacgtgacttgatcattgcagtcaaacccaggcacccccgagtcaagagtggagcccccatacctgtcacagtgagcctggtcccgttcccaaagtggaggggtgaattatgtcgacttcggaacgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggttcggaacgtgacttgctgagcgggctggcaaggc

SEQ ID NO: 787 - DNA, 495 bp, Artificial Sequence
  Oligonucleotide
gcctccctcgcgccatcagaagtaacggtgacttggggtcgtgcaggctgggctgctcaccctctctcccacctggagcccccttcttacctagcacggtgagccgtgtccctggcccgaagaactgctcattgtgtcgacaagtaacggtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggaagtaacggtgacttgctgagcgggctggcaaggc

SEQ ID NO: 788 - DNA, 495 bp, Artificial Sequence
  Oligonucleotide
gcctccctcgcgccatcaggtctcctagtgacttgcctctgcccatcccgccctctcggagctctccggagccccaaccgcctccttacccagtacggtcagcctagagccttctccaaaaaacagctccccggtgtcgacgtctcctagtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttgggggggtctcctagtgacttgctgagcgggctggcaaggc

SEQ ID NO: 789 - DNA, 495 bp, Artificial Sequence
  Oligonucleotide
gcctccctcgcgccatcaggtagacacgtgacttggcgtcccggggcgccccctccccagttccggggcttcagcgggagcccccgcttaccgagcactgtcagccgggtgcctgggccaaaatactgcgtatctgtcgacgtagacacgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttgggggggtagacacgtgacttgctgagcgggctggcaaggc

SEQ ID NO: 790 - DNA, 495 bp, Artificial Sequence
  Oligonucleotide
gcctccctcgcgccatcagcactgtacgtgacttgcgcacaaaaacccgagcgcagtctcgtccccggtcccccggcggccccagcttacccagcactgagagccgggtcccggcgccgaagtactgaatgttttgtcgaccactgtacgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggcactgtacgtgacttgctgagcgggctggcaaggc

SEQ ID NO: 791 - DNA, 495 bp, Artificial Sequence
  Oligonucleotide
gcctccctcgcgccatcaggatgatccgtgacttgccccgcaaaaaccagacccaagccgcccgcgcccgcgccccagcagcccgcgctcaccgagcaccaggagccgcgtgcctggcccgaagtactgggtctcgtcgacgatgatccgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttgggggggatgatccgtgacttgctgagcgggctggcaaggc

SEQ ID NO: 792 - DNA, 495 bp, Artificial Sequence
  Oligonucleotide
gcctccctcgcgccatcagcgccaatagtgacttgccgccgccttccacctgaatcccgccgcccgggtggtcccgcgaaaactcacccagcacggtcagcctgctgccggccccgaaagtcaggacgttggcccgtcgaccgccaatagtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggcgccaatagtgacttgctgagcgggctggcaaggc

SEQ ID NO: 793 - DNA, 495 bp, Artificial Sequence
  Oligonucleotide
gcctccctcgcgccatcagtcaagcctgtgacttgccaccctccgactccggggaccgaggggctggaaggtggggagacgcccgaatctcacctgtgaccgtgagcctggtgcccggcccgaagtactgctcgtgtcgactcaagcctgtgacttgtcactgctggcatagagatacacagatgtctggttggtgctggcagacttcagggtcaggggaaaagatgctatagtatttcaagaaacatgatacccctcagagatatctcctttttcagtgctcccagtgccaggtgaataatagaccagcttcagtccaagtcctgggtcctgtcgataccagtacattgtaacatgattcatattctgggaacactgtagaatgaattcctttcctgtcccaatgattctgtgtcttgggaattgtgtaactacagcatccttgaggcctgttggggggtcaagcctgtgacttgctgagcgggctggcaaggc

SEQ ID NO: 794 - DNA, 495 bp, Artificial Sequence
  Oligonucleotide
gcctccctcgcgccatcagagagtgtcaagccatcctgtggacccacttttccctgtgacggatctgcaaaagaacctgaaaaatgtcttacctacaactgtgagtctggtgccttgtccaaagaaagcttcagtgtcgacagagtgtcaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaaagagtgtcaagccatcctgagcgggctggcaaggc

SEQ ID NO: 795 - DNA, 495 bp, Artificial Sequence
  Oligonucleotide
gcctccctcgcgccatcaggttccgaaaagccatcatttcccaggacagagtcctccctcatcgcacccctcctagagacccccagccttacctacaacggttaacctggtccccgaaccgaaggtgtagccatagtcgacgttccgaaaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaagttccgaaaagccatcctgagcgggctggcaaggc

SEQ ID NO: 796 - DNA, 495 bp, Artificial Sequence
  Oligonucleotide
gcctccctcgcgccatcagcgttacttaagccatcctggattccagcccctttttgcaagttcccagctgtccagccttgacttactcacctacaacagtgagccaacttccctctccaaaatatatggtgtttcgtcgaccgttacttaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaacgttacttaagccatcctgagcgggctggcaaggc

SEQ ID NO: 797 - DNA, 495 bp, Artificial Sequence
  Oligonucleotide
gcctccctcgcgccatcagtaggagacaagccatcctcctggaactccgaccttatgatacactatcccgaaagaagtcttttacatacccaagacagagagctgggttccactgccaaaaaacagtttttcattgtcgactaggagacaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaataggagacaagccatcctgagcgggctggcaaggc

SEQ ID NO: 798 - DNA, 495 bp, Artificial Sequence
  Oligonucleotide
gcctccctcgcgccatcaggacactctaagccatcagagaactctgccttcaagggacaatggccataccaccctgattctgcaacttacctaggatggagagtcgagtcccatcaccaaaatgctggggctgatgtcgacgacactctaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaagacactctaagccatcctgagcgggctggcaaggc

SEQ ID NO: 799 - DNA, 495 bp, Artificial Sequence
  Oligonucleotide
gcctccctcgcgccatcagttcggaacaagccatcatcattgcagtcaaacccaggcacccccgagtcaagagtggagcccccatacctgtcacagtgagcctggtcccgttcccaaagtggaggggtgaattatgtcgacttcggaacaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaattcggaacaagccatcctgagcgggctggcaaggc

SEQ ID NO: 800 - DNA, 495 bp, Artificial Sequence
  Oligonucleotide
gcctccctcgcgccatcagaagtaacgaagccatcgggtcgtgcaggctgggctgctcaccctctctcccacctggagcccccttcttacctagcacggtgagccgtgtccctggcccgaagaactgctcattgtgtcgacaagtaacgaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaaaagtaacgaagccatcctgagcgggctggcaaggc

SEQ ID NO: 801 - DNA, 495 bp, Artificial Sequence
  Oligonucleotide
gcctccctcgcgccatcaggtctcctaaagccatccctctgcccatcccgccctctcggagctctccggagccccaaccgcctccttacccagtacggtcagcctagagccttctccaaaaaacagctccccggtgtcgacgtctcctaaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaagtctcctaaagccatcctgagcgggctggcaaggc

SEQ ID NO: 802 - DNA, 495 bp, Artificial Sequence
  Oligonucleotide
gcctccctcgcgccatcaggtagacacaagccatcgcgtcccggggcgccccctccccagttccggggcttcagcgggagcccccgcttaccgagcactgtcagccgggtgcctgggccaaaatactgcgtatctgtcgacgtagacacaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaagtagacacaagccatcctgagcgggctggcaaggc

SEQ ID NO: 803 - DNA, 495 bp, Artificial Sequence
  Oligonucleotide
gcctccctcgcgccatcagcactgtacaagccatccgcacaaaaacccgagcgcagtctcgtccccggtcccccggcggccccagcttacccagcactgagagccgggtcccggcgccgaagtactgaatgttttgtcgaccactgtacaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaacactgtacaagccatcctgagcgggctggcaaggc

SEQ ID NO: 804 - DNA, 495 bp, Artificial Sequence
  Oligonucleotide
gcctccctcgcgccatcaggatgatccaagccatcccccgcaaaaaccagacccaagccgcccgcgcccgcgccccagcagcccgcgctcaccgagcaccaggagccgcgtgcctggcccgaagtactgggtctcgtcgacgatgatccaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaagatgatccaagccatcctgagcgggctggcaaggc

SEQ ID NO: 805 - DNA, 495 bp, Artificial Sequence
  Oligonucleotide
gcctccctcgcgccatcagcgccaataaagccatcccgccgccttccacctgaatcccgccgcccgggtggtcccgcgaaaactcacccagcacggtcagcctgctgccggccccgaaagtcaggacgttggcccgtcgaccgccaataaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaacgccaataaagccatcctgagcgggctggcaaggc

SEQ ID NO: 806 - DNA, 495 bp, Artificial Sequence
  Oligonucleotide
gcctccctcgcgccatcagtcaagcctaagccatcccaccctccgactccggggaccgaggggctggaaggtggggagacgcccgaatctcacctgtgaccgtgagcctggtgcccggcccgaagtactgctcgtgtcgactcaagcctaagccatctcactgctggcacagaagtacagagaggtctggttggggctgggcgactccaggatcagggggaaattcctcttctcttttcgagagactttgtacccttcaggaacatctcccttatcagtcacctcaacattcattgaatagtagatctgccttaagcccagccctgggtcttgtcgataccaggacatatactcatggttcatattctgagaacaagtcactgttaacttctttccagtcactgtgatgaggtatcttgggttctgggtcacttgggcttccagggggcctgtaaaggaatcaagcctaagccatcctgagcgggctggcaaggc

SEQ ID NO: 807 - DNA, 495 bp, Artificial Sequence
  Oligonucleotide
gcctccctcgcgccatcagagagtgtcgattgcagctgtggacccacttttccctgtgacggatctgcaaaagaacctgaaaaatgtcttacctacaactgtgagtctggtgccttgtccaaagaaagcttcagtgtcgacagagtgtcgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacagagtgtcgattgcagctgagcgggctggcaaggc

SEQ ID NO: 808 - DNA, 495 bp, Artificial Sequence
  Oligonucleotide
gcctccctcgcgccatcaggttccgaagattgcagatttcccaggacagagtcctccctcatcgcacccctcctagagacccccagccttacctacaacggttaacctggtccccgaaccgaaggtgtagccatagtcgacgttccgaagattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacgttccgaagattgcagctgagcgggctggcaaggc

SEQ ID NO: 809 - DNA, 495 bp, Artificial Sequence
  Oligonucleotide
gcctccctcgcgccatcagcgttacttgattgcagctggattccagcccctttttgcaagttcccagctgtccagccttgacttactcacctacaacagtgagccaacttccctctccaaaatatatggtgtttcgtcgaccgttacttgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagaccgttacttgattgcagctgagcgggctggcaaggc

SEQ ID NO: 810 - DNA, 495 bp, Artificial Sequence
  Oligonucleotide
gcctccctcgcgccatcagtaggagacgattgcagctcctggaactccgaccttatgatacactatcccgaaagaagtcttttacatacccaagacagagagctgggttccactgccaaaaaacagtttttcattgtcgactaggagacgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagactaggagacgattgcagctgagcgggctggcaaggc

SEQ ID NO: 811 - DNA, 495 bp, Artificial Sequence
  Oligonucleotide
gcctccctcgcgccatcaggacactctgattgcagagagaactctgccttcaagggacaatggccataccaccctgattctgcaacttacctaggatggagagtcgagtcccatcaccaaaatgctggggctgatgtcgacgacactctgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacgacactctgattgcagctgagcgggctggcaaggc

SEQ ID NO: 812 - DNA, 495 bp, Artificial Sequence
  Oligonucleotide
gcctccctcgcgccatcagttcggaacgattgcagatcattgcagtcaaacccaggcacccccgagtcaagagtggagcccccatacctgtcacagtgagcctggtcccgttcccaaagtggaggggtgaattatgtcgacttcggaacgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacttcggaacgattgcagctgagcgggctggcaaggc

SEQ ID NO: 813 - DNA, 495 bp, Artificial Sequence
  Oligonucleotide
gcctccctcgcgccatcagaagtaacggattgcaggggtcgtgcaggctgggctgctcaccctctctcccacctggagcccccttcttacctagcacggtgagccgtgtccctggcccgaagaactgctcattgtgtcgacaagtaacggattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacaagtaacggattgcagctgagcgggctggcaaggc

SEQ ID NO: 814 - DNA, 495 bp, Artificial Sequence
  Oligonucleotide
gcctccctcgcgccatcaggtctcctagattgcagcctctgcccatcccgccctctcggagctctccggagccccaaccgcctccttacccagtacggtcagcctagagccttctccaaaaaacagctccccggtgtcgacgtctcctagattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacgtctcctagattgcagctgagcgggctggcaaggc

SEQ ID NO: 815 - DNA, 495 bp, Artificial Sequence
  Oligonucleotide
gcctccctcgcgccatcaggtagacacgattgcaggcgtcccggggcgccccctccccagttccggggcttcagcgggagcccccgcttaccgagcactgtcagccgggtgcctgggccaaaatactgcgtatctgtcgacgtagacacgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacgtagacacgattgcagctgagcgggctggcaaggc

SEQ ID NO: 816 - DNA, 495 bp, Artificial Sequence
  Oligonucleotide
gcctccctcgcgccatcagcactgtacgattgcagcgcacaaaaacccgagcgcagtctcgtccccggtcccccggcggccccagcttacccagcactgagagccgggtcccggcgccgaagtactgaatgttttgtcgaccactgtacgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagaccactgtacgattgcagctgagcgggctggcaaggc

SEQ ID NO: 817 - DNA, 495 bp, Artificial Sequence
  Oligonucleotide
gcctccctcgcgccatcaggatgatccgattgcagccccgcaaaaaccagacccaagccgcccgcgcccgcgccccagcagcccgcgctcaccgagcaccaggagccgcgtgcctggcccgaagtactgggtctcgtcgacgatgatccgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagacgatgatccgattgcagctgagcgggctggcaaggc

SEQ ID NO: 818 - DNA, 495 bp, Artificial Sequence
  Oligonucleotide
gcctccctcgcgccatcagcgccaatagattgcagccgccgccttccacctgaatcccgccgcccgggtggtcccgcgaaaactcacccagcacggtcagcctgctgccggccccgaaagtcaggacgttggcccgtcgaccgccaatagattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagaccgccaatagattgcagctgagcgggctggcaaggc

SEQ ID NO: 819 - DNA, 495 bp, Artificial Sequence
  Oligonucleotide
gcctccctcgcgccatcagtcaagcctgattgcagccaccctccgactccggggaccgaggggctggaaggtggggagacgcccgaatctcacctgtgaccgtgagcctggtgcccggcccgaagtactgctcgtgtcgactcaagcctgattgcagtcactgctggcacagaggtacatagatgtctggttggtgctggcggactccagaatcagggagaagcgctccttcttctctctagagacactgtacccctcaggaatatctcctttttctttcattttaacatcatatgagaaatagatcagccgtagccccagacctgggtcttgtcgataccagaacatattttcatggtccatatcctggacacattccagaaaaactttctctcccgtccttttgactagatatctcgagctctgggttactttcacatctacgaggcctgtgagagactcaagcctgattgcagctgagcgggctggcaaggc

SEQ ID NO: 820 - DNA, 495 bp, Artificial Sequence
  Oligonucleotide
gcctccctcgcgccatcagagagtgtcactatgacctgtggacccacttttccctgtgacggatctgcaaaagaacctgaaaaatgtcttacctacaactgtgagtctggtgccttgtccaaagaaagcttcagtgtcgacagagtgtcactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtagagtgtcactatgacctgagcgggctggcaaggc

SEQ ID NO: 821 - DNA, 495 bp, Artificial Sequence
  Oligonucleotide
gcctccctcgcgccatcaggttccgaaactatgacatttcccaggacagagtcctccctcatcgcacccctcctagagacccccagccttacctacaacggttaacctggtccccgaaccgaaggtgtagccatagtcgacgttccgaaactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtgttccgaaactatgacctgagcgggctggcaaggc

SEQ ID NO: 822 - DNA, 495 bp, Artificial Sequence
  Oligonucleotide
gcctccctcgcgccatcagcgttacttactatgacctggattccagcccctttttgcaagttcccagctgtccagccttgacttactcacctacaacagtgagccaacttccctctccaaaatatatggtgtttcgtcgaccgttacttactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtcgttacttactatgacctgagcgggctggcaaggc

SEQ ID NO: 823 - DNA, 495 bp, Artificial Sequence
  Oligonucleotide
gcctccctcgcgccatcagtaggagacactatgacctcctggaactccgaccttatgatacactatcccgaaagaagtcttttacatacccaagacagagagctgggttccactgccaaaaaacagtttttcattgtcgactaggagacactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagttaggagacactatgacctgagcgggctggcaaggc

SEQ ID NO: 824 - DNA, 495 bp, Artificial Sequence
  Oligonucleotide
gcctccctcgcgccatcaggacactctactatgacagagaactctgccttcaagggacaatggccataccaccctgattctgcaacttacctaggatggagagtcgagtcccatcaccaaaatgctggggctgatgtcgacgacactctactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtgacactctactatgacctgagcgggctggcaaggc

SEQ ID NO: 825 - DNA, 495 bp, Artificial Sequence
  Oligonucleotide
gcctccctcgcgccatcagttcggaacactatgacatcattgcagtcaaacccaggcacccccgagtcaagagtggagcccccatacctgtcacagtgagcctggtcccgttcccaaagtggaggggtgaattatgtcgacttcggaacactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtttcggaacactatgacctgagcgggctggcaaggc

SEQ ID NO: 826 - DNA, 495 bp, Artificial Sequence
  Oligonucleotide
gcctccctcgcgccatcagaagtaacgactatgacgggtcgtgcaggctgggctgctcaccctctctcccacctggagcccccttcttacctagcacggtgagccgtgtccctggcccgaagaactgctcattgtgtcgacaagtaacgactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtaagtaacgactatgacctgagcgggctggcaaggc

SEQ ID NO: 827 - DNA, 495 bp, Artificial Sequence
  Oligonucleotide
gcctccctcgcgccatcaggtctcctaactatgaccctctgcccatcccgccctctcggagctctccggagccccaaccgcctccttacccagtacggtcagcctagagccttctccaaaaaacagctccccggtgtcgacgtctcctaactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtgtctcctaactatgacctgagcgggctggcaaggc

SEQ ID NO: 828 - DNA, 495 bp, Artificial Sequence
  Oligonucleotide
gcctccctcgcgccatcaggtagacacactatgacgcgtcccggggcgccccctccccagttccggggcttcagcgggagcccccgcttaccgagcactgtcagccgggtgcctgggccaaaatactgcgtatctgtcgacgtagacacactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtgtagacacactatgacctgagcgggctggcaaggc

SEQ ID NO: 829 - DNA, 495 bp, Artificial Sequence
  Oligonucleotide
gcctccctcgcgccatcagcactgtacactatgaccgcacaaaaacccgagcgcagtctcgtccccggtcccccggcggccccagcttacccagcactgagagccgggtcccggcgccgaagtactgaatgttttgtcgaccactgtacactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtcactgtacactatgacctgagcgggctggcaaggc

SEQ ID NO: 830 - DNA, 495 bp, Artificial Sequence
  Oligonucleotide
gcctccctcgcgccatcaggatgatccactatgacccccgcaaaaaccagacccaagccgcccgcgcccgcgccccagcagcccgcgctcaccgagcaccaggagccgcgtgcctggcccgaagtactgggtctcgtcgacgatgatccactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtgatgatccactatgacctgagcgggctggcaaggc

SEQ ID NO: 831 - DNA, 495 bp, Artificial Sequence
  Oligonucleotide
gcctccctcgcgccatcagcgccaataactatgacccgccgccttccacctgaatcccgccgcccgggtggtcccgcgaaaactcacccagcacggtcagcctgctgccggccccgaaagtcaggacgttggcccgtcgaccgccaataactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagtcgccaataactatgacctgagcgggctggcaaggc

SEQ ID NO: 832 - DNA, 495 bp, Artificial Sequence
  Oligonucleotide
gcctccctcgcgccatcagtcaagcctactatgacccaccctccgactccggggaccgaggggctggaaggtggggagacgcccgaatctcacctgtgaccgtgagcctggtgcccggcccgaagtactgctcgtgtcgactcaagcctactatgactcaacgctgcagagatatatgctgctgtcttcagggctcatgttgctcacagtcagagttgagaatgttaggtttgggcggctgatgggaaacttgtcaatgacaaatccactctcatatgtggcctcagagccctgatttgcagttgcgatcagtgtcaggctctgtccaggttgctgacggtaccagaacatcatggtgacttggctatcgacttgacactggatcgtcagggaggttccacgttgacagatatccctgcttggcttttgagagatgacagcactgaacacagagcctagttcaagcctactatgacctgagcgggctggcaaggc

SEQ ID NO: 833 - DNA, 495 bp, Artificial Sequence
  Oligonucleotide
gcctccctcgcgccatcagagagtgtctccatgtgctgtggacccacttttccctgtgacggatctgcaaaagaacctgaaaaatgtcttacctacaactgtgagtctggtgccttgtccaaagaaagcttcagtgtcgacagagtgtctccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagataagagtgtctccatgtgctgagcgggctggcaaggc

SEQ ID NO: 834 - DNA, 495 bp, Artificial Sequence
  Oligonucleotide
gcctccctcgcgccatcaggttccgaatccatgtgatttcccaggacagagtcctccctcatcgcacccctcctagagacccccagccttacctacaacggttaacctggtccccgaaccgaaggtgtagccatagtcgacgttccgaatccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatagttccgaatccatgtgctgagcgggctggcaaggc

SEQ ID NO: 835 - DNA, 495 bp, Artificial Sequence
  Oligonucleotide
gcctccctcgcgccatcagcgttactttccatgtgctggattccagcccctttttgcaagttcccagctgtccagccttgacttactcacctacaacagtgagccaacttccctctccaaaatatatggtgtttcgtcgaccgttactttccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatacgttactttccatgtgctgagcgggctggcaaggc

SEQ ID NO: 836 - DNA, 495 bp, Artificial Sequence
  Oligonucleotide
gcctccctcgcgccatcagtaggagactccatgtgctcctggaactccgaccttatgatacactatcccgaaagaagtcttttacatacccaagacagagagctgggttccactgccaaaaaacagtttttcattgtcgactaggagactccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatataggagactccatgtgctgagcgggctggcaaggc

SEQ ID NO: 837 - DNA, 495 bp, Artificial Sequence
  Oligonucleotide
gcctccctcgcgccatcaggacactcttccatgtgagagaactctgccttcaagggacaatggccataccaccctgattctgcaacttacctaggatggagagtcgagtcccatcaccaaaatgctggggctgatgtcgacgacactcttccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatagacactcttccatgtgctgagcgggctggcaaggc

SEQ ID NO: 838 - DNA, 495 bp, Artificial Sequence
  Oligonucleotide
gcctccctcgcgccatcagttcggaactccatgtgatcattgcagtcaaacccaggcacccccgagtcaagagtggagcccccatacctgtcacagtgagcctggtcccgttcccaaagtggaggggtgaattatgtcgacttcggaactccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatattcggaactccatgtgctgagcgggctggcaaggc

SEQ ID NO: 839 - DNA, 495 bp, Artificial Sequence
  Oligonucleotide
gcctccctcgcgccatcagaagtaacgtccatgtggggtcgtgcaggctgggctgctcaccctctctcccacctggagcccccttcttacctagcacggtgagccgtgtccctggcccgaagaactgctcattgtgtcgacaagtaacgtccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagataaagtaacgtccatgtgctgagcgggctggcaaggc

SEQ ID NO: 840 - DNA, 495 bp, Artificial Sequence
  Oligonucleotide
gcctccctcgcgccatcaggtctcctatccatgtgcctctgcccatcccgccctctcggagctctccggagccccaaccgcctccttacccagtacggtcagcctagagccttctccaaaaaacagctccccggtgtcgacgtctcctatccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatagtctcctatccatgtgctgagcgggctggcaaggc

SEQ ID NO: 841 - DNA, 495 bp, Artificial Sequence
  Oligonucleotide
gcctccctcgcgccatcaggtagacactccatgtggcgtcccggggcgccccctccccagttccggggcttcagcgggagcccccgcttaccgagcactgtcagccgggtgcctgggccaaaatactgcgtatctgtcgacgtagacactccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatagtagacactccatgtgctgagcgggctggcaaggc

SEQ ID NO: 842 - DNA, 495 bp, Artificial Sequence
  Oligonucleotide
gcctccctcgcgccatcagcactgtactccatgtgcgcacaaaaacccgagcgcagtctcgtccccggtcccccggcggccccagcttacccagcactgagagccgggtcccggcgccgaagtactgaatgttttgtcgaccactgtactccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatacactgtactccatgtgctgagcgggctggcaaggc

SEQ ID NO: 843 - DNA, 495 bp, Artificial Sequence
  Oligonucleotide
gcctccctcgcgccatcaggatgatcctccatgtgccccgcaaaaaccagacccaagccgcccgcgcccgcgccccagcagcccgcgctcaccgagcaccaggagccgcgtgcctggcccgaagtactgggtctcgtcgacgatgatcctccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatagatgatcctccatgtgctgagcgggctggcaaggc

SEQ ID NO: 844 - DNA, 495 bp, Artificial Sequence
  Oligonucleotide
gcctccctcgcgccatcagcgccaatatccatgtgccgccgccttccacctgaatcccgccgcccgggtggtcccgcgaaaactcacccagcacggtcagcctgctgccggccccgaaagtcaggacgttggcccgtcgaccgccaatatccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatacgccaatatccatgtgctgagcgggctggcaaggc

SEQ ID NO: 845 - DNA, 495 bp, Artificial Sequence
  Oligonucleotide
gcctccctcgcgccatcagtcaagccttccatgtgccaccctccgactccggggaccgaggggctggaaggtggggagacgcccgaatctcacctgtgaccgtgagcctggtgcccggcccgaagtactgctcgtgtcgactcaagccttccatgtgtcacaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagatatcaagccttccatgtgctgagcgggctggcaaggc

SEQ ID NO: 846 - DNA, 495 bp, Artificial Sequence
  Oligonucleotide
gcctccctcgcgccatcagagagtgtcatggtcaactgtggacccacttttccctgtgacggatctgcaaaagaacctgaaaaatgtcttacctacaactgtgagtctggtgccttgtccaaagaaagcttcagtgtcgacagagtgtcatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagaagagtgtcatggtcaactgagcgggctggcaaggc

SEQ ID NO: 847 - DNA, 495 bp, Artificial Sequence
  Oligonucleotide
gcctccctcgcgccatcaggttccgaaatggtcaaatttcccaggacagagtcctccctcatcgcacccctcctagagacccccagccttacctacaacggttaacctggtccccgaaccgaaggtgtagccatagtcgacgttccgaaatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagagttccgaaatggtcaactgagcgggctggcaaggc

SEQ ID NO: 848 - DNA, 495 bp, Artificial Sequence
  Oligonucleotide
gcctccctcgcgccatcagcgttacttatggtcaactggattccagcccctttttgcaagttcccagctgtccagccttgacttactcacctacaacagtgagccaacttccctctccaaaatatatggtgtttcgtcgaccgttacttatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagacgttacttatggtcaactgagcgggctggcaaggc

SEQ ID NO: 849 - DNA, 495 bp, Artificial Sequence
  Oligonucleotide
gcctccctcgcgccatcagtaggagacatggtcaactcctggaactccgaccttatgatacactatcccgaaagaagtcttttacatacccaagacagagagctgggttccactgccaaaaaacagtttttcattgtcgactaggagacatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagataggagacatggtcaactgagcgggctggcaaggc

SEQ ID NO: 850 - DNA, 495 bp, Artificial Sequence
  Oligonucleotide
gcctccctcgcgccatcaggacactctatggtcaaagagaactctgccttcaagggacaatggccataccaccctgattctgcaacttacctaggatggagagtcgagtcccatcaccaaaatgctggggctgatgtcgacgacactctatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagagacactctatggtcaactgagcgggctggcaaggc

SEQ ID NO: 851 - DNA, 495 bp, Artificial Sequence
  Oligonucleotide
gcctccctcgcgccatcagttcggaacatggtcaaatcattgcagtcaaacccaggcacccccgagtcaagagtggagcccccatacctgtcacagtgagcctggtcccgttcccaaagtggaggggtgaattatgtcgacttcggaacatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagattcggaacatggtcaactgagcgggctggcaaggc

SEQ ID NO: 852 - DNA, 495 bp, Artificial Sequence
  Oligonucleotide
gcctccctcgcgccatcagaagtaacgatggtcaagggtcgtgcaggctgggctgctcaccctctctcccacctggagcccccttcttacctagcacggtgagccgtgtccctggcccgaagaactgctcattgtgtcgacaagtaacgatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagaaagtaacgatggtcaactgagcgggctggcaaggc

SEQ ID NO: 853 - DNA, 495 bp, Artificial Sequence
  Oligonucleotide
gcctccctcgcgccatcaggtctcctaatggtcaacctctgcccatcccgccctctcggagctctccggagccccaaccgcctccttacccagtacggtcagcctagagccttctccaaaaaacagctccccggtgtcgacgtctcctaatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagagtctcctaatggtcaactgagcgggctggcaaggc

SEQ ID NO: 854 - DNA, 495 bp, Artificial Sequence
  Oligonucleotide
gcctccctcgcgccatcaggtagacacatggtcaagcgtcccggggcgccccctccccagttccggggcttcagcgggagcccccgcttaccgagcactgtcagccgggtgcctgggccaaaatactgcgtatctgtcgacgtagacacatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagagtagacacatggtcaactgagcgggctggcaaggc

SEQ ID NO: 855 - DNA, 495 bp, Artificial Sequence
  Oligonucleotide
gcctccctcgcgccatcagcactgtacatggtcaacgcacaaaaacccgagcgcagtctcgtccccggtcccccggcggccccagcttacccagcactgagagccgggtcccggcgccgaagtactgaatgttttgtcgaccactgtacatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagacactgtacatggtcaactgagcgggctggcaaggc

SEQ ID NO: 856 - DNA, 495 bp, Artificial Sequence
  Oligonucleotide
gcctccctcgcgccatcaggatgatccatggtcaaccccgcaaaaaccagacccaagccgcccgcgcccgcgccccagcagcccgcgctcaccgagcaccaggagccgcgtgcctggcccgaagtactgggtctcgtcgacgatgatccatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagagatgatccatggtcaactgagcgggctggcaaggc

SEQ ID NO: 857 - DNA, 495 bp, Artificial Sequence
  Oligonucleotide
gcctccctcgcgccatcagcgccaataatggtcaaccgccgccttccacctgaatcccgccgcccgggtggtcccgcgaaaactcacccagcacggtcagcctgctgccggccccgaaagtcaggacgttggcccgtcgaccgccaataatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagacgccaataatggtcaactgagcgggctggcaaggc

SEQ ID NO: 858 - DNA, 495 bp, Artificial Sequence
  Oligonucleotide
gcctccctcgcgccatcagtcaagcctatggtcaaccaccctccgactccggggaccgaggggctggaaggtggggagacgcccgaatctcacctgtgaccgtgagcctggtgcccggcccgaagtactgctcgtgtcgactcaagcctatggtcaatcacggtacaaggacacagggacacctgaaagggagttgcagatttcagagccaaagagaacttctattttttgccaggaaatattttcaatagggatatgtctctaatcaacaatgtcaatgttaactgaataatgagtcggctctaattccaaccctgattcttgtgaaaaccagtatgaaatcttggcacttatcttgagaactcctttcctgtctctgcaatcaggtgtcttagagtctaggtggcttcagcttctacgagctggggtttatgagctgaggggacagaagacagaaagatcaagcctatggtcaactgagcgggctggcaaggc

SEQ ID NO: 859 - DNA, 495 bp, Artificial Sequence
  Oligonucleotide
gcctccctcgcgccatcagagagtgtccaagtcacctgtggacccacttttccctgtgacggatctgcaaaagaacctgaaaaatgtcttacctacaactgtgagtctggtgccttgtccaaagaaagcttcagtgtcgacagagtgtccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgagagtgtccaagtcacctgagcgggctggcaaggc

SEQ ID NO: 860 - DNA, 495 bp, Artificial Sequence
  Oligonucleotide
gcctccctcgcgccatcaggttccgaacaagtcacatttcccaggacagagtcctccctcatcgcacccctcctagagacccccagccttacctacaacggttaacctggtccccgaaccgaaggtgtagccatagtcgacgttccgaacaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctggttccgaacaagtcacctgagcgggctggcaaggc

SEQ ID NO: 861 - DNA, 495 bp, Artificial Sequence
  Oligonucleotide
gcctccctcgcgccatcagcgttacttcaagtcacctggattccagcccctttttgcaagttcccagctgtccagccttgacttactcacctacaacagtgagccaacttccctctccaaaatatatggtgtttcgtcgaccgttacttcaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgcgttacttcaagtcacctgagcgggctggcaaggc

SEQ ID NO: 862 - DNA, 495 bp, Artificial Sequence
  Oligonucleotide
gcctccctcgcgccatcagtaggagaccaagtcacctcctggaactccgaccttatgatacactatcccgaaagaagtcttttacatacccaagacagagagctgggttccactgccaaaaaacagtttttcattgtcgactaggagaccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgtaggagaccaagtcacctgagcgggctggcaaggc

SEQ ID NO: 863 - DNA, 495 bp, Artificial Sequence
  Oligonucleotide
gcctccctcgcgccatcaggacactctcaagtcacagagaactctgccttcaagggacaatggccataccaccctgattctgcaacttacctaggatggagagtcgagtcccatcaccaaaatgctggggctgatgtcgacgacactctcaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctggacactctcaagtcacctgagcgggctggcaaggc

SEQ ID NO: 864 - DNA, 495 bp, Artificial Sequence
  Oligonucleotide
gcctccctcgcgccatcagttcggaaccaagtcacatcattgcagtcaaacccaggcacccccgagtcaagagtggagcccccatacctgtcacagtgagcctggtcccgttcccaaagtggaggggtgaattatgtcgacttcggaaccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgttcggaaccaagtcacctgagcgggctggcaaggc

SEQ ID NO: 865 - DNA, 495 bp, Artificial Sequence
  Oligonucleotide
gcctccctcgcgccatcagaagtaacgcaagtcacgggtcgtgcaggctgggctgctcaccctctctcccacctggagcccccttcttacctagcacggtgagccgtgtccctggcccgaagaactgctcattgtgtcgacaagtaacgcaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgaagtaacgcaagtcacctgagcgggctggcaaggc

SEQ ID NO: 866 - DNA, 495 bp, Artificial Sequence
  Oligonucleotide
gcctccctcgcgccatcaggtctcctacaagtcaccctctgcccatcccgccctctcggagctctccggagccccaaccgcctccttacccagtacggtcagcctagagccttctccaaaaaacagctccccggtgtcgacgtctcctacaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctggtctcctacaagtcacctgagcgggctggcaaggc

SEQ ID NO: 867 - DNA, 495 bp, Artificial Sequence
  Oligonucleotide
gcctccctcgcgccatcaggtagacaccaagtcacgcgtcccggggcgccccctccccagttccggggcttcagcgggagcccccgcttaccgagcactgtcagccgggtgcctgggccaaaatactgcgtatctgtcgacgtagacaccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctggtagacaccaagtcacctgagcgggctggcaaggc

SEQ ID NO: 868 - DNA, 495 bp, Artificial Sequence
  Oligonucleotide
gcctccctcgcgccatcagcactgtaccaagtcaccgcacaaaaacccgagcgcagtctcgtccccggtcccccggcggccccagcttacccagcactgagagccgggtcccggcgccgaagtactgaatgttttgtcgaccactgtaccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgcactgtaccaagtcacctgagcgggctggcaaggc

SEQ ID NO: 869 - DNA, 495 bp, Artificial Sequence
  Oligonucleotide
gcctccctcgcgccatcaggatgatcccaagtcacccccgcaaaaaccagacccaagccgcccgcgcccgcgccccagcagcccgcgctcaccgagcaccaggagccgcgtgcctggcccgaagtactgggtctcgtcgacgatgatcccaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctggatgatcccaagtcacctgagcgggctggcaaggc

SEQ ID NO: 870 - DNA, 495 bp, Artificial Sequence
  Oligonucleotide
gcctccctcgcgccatcagcgccaatacaagtcacccgccgccttccacctgaatcccgccgcccgggtggtcccgcgaaaactcacccagcacggtcagcctgctgccggccccgaaagtcaggacgttggcccgtcgaccgccaatacaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgcgccaatacaagtcacctgagcgggctggcaaggc

SEQ ID NO: 871 - DNA, 495 bp, Artificial Sequence
  Oligonucleotide
gcctccctcgcgccatcagtcaagcctcaagtcacccaccctccgactccggggaccgaggggctggaaggtggggagacgcccgaatctcacctgtgaccgtgagcctggtgcccggcccgaagtactgctcgtgtcgactcaagcctcaagtcactcacatatccgctcagagaggatgtggctgcactgataggctgctgctgcagagggtctcagagtctggttagtgctggacgatttaagggttgggaaagatgattattttttcccttttttctttttggttagaatgactatgctgactcagggcatctttttcaaagctgccaacttcagaagaataattaatagattaaatttatccccagccctggatcttatggattccagaacgtttggtctggttgatagtctgaaaacattccgatacaactttcctgcctcatctcagggtctgtcaagcctcaagtcacctgagcgggctggcaaggc

SEQ ID NO: 872 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacactgaagctttctttggacaaggcaccagactcacagttgtaggtaagacatttttcaggttcttttgcagatccggcatgcat

SEQ ID NO: 873 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacactgaagctttctttggacaaggcaccagactcacagttgtaggtaagacatttttcaggttcttttgcagatccggcatgcat

SEQ ID NO: 874 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacactgaagctttctttggacaaggcaccagactcacagttgtaggtaagacatttttcaggttcttttgcagatccggcatgcat

SEQ ID NO: 875 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacactgaagctttctttggacaaggcaccagactcacagttgtaggtaagacatttttcaggttcttttgcagatccggcatgcat

SEQ ID NO: 876 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacactgaagctttctttggacaaggcaccagactcacagttgtaggtaagacatttttcaggttcttttgcagatccggcatgcat

SEQ ID NO: 877 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacactgaagctttctttggacaaggcaccagactcacagttgtaggtaagacatttttcaggttcttttgcagatccggcatgcat

SEQ ID NO: 878 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacactgaagctttctttggacaaggcaccagactcacagttgtaggtaagacatttttcaggttcttttgcagatccggcatgcat

SEQ ID NO: 879 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacactgaagctttctttggacaaggcaccagactcacagttgtaggtaagacatttttcaggttcttttgcagatccggcatgcat

SEQ ID NO: 880 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacactgaagctttctttggacaaggcaccagactcacagttgtaggtaagacatttttcaggttcttttgcagatccggcatgcat

SEQ ID NO: 881 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacactgaagctttctttggacaaggcaccagactcacagttgtaggtaagacatttttcaggttcttttgcagatccggcatgcat

SEQ ID NO: 882 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacactgaagctttctttggacaaggcaccagactcacagttgtaggtaagacatttttcaggttcttttgcagatccggcatgcat

SEQ ID NO: 883 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacactgaagctttctttggacaaggcaccagactcacagttgtaggtaagacatttttcaggttcttttgcagatccggcatgcat

SEQ ID NO: 884 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacactgaagctttctttggacaaggcaccagactcacagttgtaggtaagacatttttcaggttcttttgcagatccggcatgcat

SEQ ID NO: 885 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacactgaagctttctttggacaaggcaccagactcacagttgtaggtaagacatttttcaggttcttttgcagatccggcatgcat

SEQ ID NO: 886 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacactgaagctttctttggacaaggcaccagactcacagttgtaggtaagacatttttcaggttcttttgcagatccggcatgcat

SEQ ID NO: 887 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacactgaagctttctttggacaaggcaccagactcacagttgtaggtaagacatttttcaggttcttttgcagatccggcatgcat

SEQ ID NO: 888 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacactgaagctttctttggacaaggcaccagactcacagttgtaggtaagacatttttcaggttcttttgcagatccggcatgcat

SEQ ID NO: 889 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacactgaagctttctttggacaaggcaccagactcacagttgtaggtaagacatttttcaggttcttttgcagatccggcatgcat

SEQ ID NO: 890 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacactgaagctttctttggacaaggcaccagactcacagttgtaggtaagacatttttcaggttcttttgcagatccggcatgcat

SEQ ID NO: 891 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacactgaagctttctttggacaaggcaccagactcacagttgtaggtaagacatttttcaggttcttttgcagatccggcatgcat

SEQ ID NO: 892 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacactgaagctttctttggacaaggcaccagactcacagttgtaggtaagacatttttcaggttcttttgcagatccggcatgcat

SEQ ID NO: 893 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacactgaagctttctttggacaaggcaccagactcacagttgtaggtaagacatttttcaggttcttttgcagatccggcatgcat

SEQ ID NO: 894 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacactgaagctttctttggacaaggcaccagactcacagttgtaggtaagacatttttcaggttcttttgcagatccggcatgcat

SEQ ID NO: 895 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacactgaagctttctttggacaaggcaccagactcacagttgtaggtaagacatttttcaggttcttttgcagatccggcatgcat

SEQ ID NO: 896 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacactgaagctttctttggacaaggcaccagactcacagttgtaggtaagacatttttcaggttcttttgcagatccggcatgcat

SEQ ID NO: 897 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacactgaagctttctttggacaaggcaccagactcacagttgtaggtaagacatttttcaggttcttttgcagatccggcatgcat

SEQ ID NO: 898 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacactgaagctttctttggacaaggcaccagactcacagttgtaggtaagacatttttcaggttcttttgcagatccggcatgcat

SEQ ID NO: 899 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacactgaagctttctttggacaaggcaccagactcacagttgtaggtaagacatttttcaggttcttttgcagatccggcatgcat

SEQ ID NO: 900 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacactgaagctttctttggacaaggcaccagactcacagttgtaggtaagacatttttcaggttcttttgcagatccggcatgcat

SEQ ID NO: 901 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacactgaagctttctttggacaaggcaccagactcacagttgtaggtaagacatttttcaggttcttttgcagatccggcatgcat

SEQ ID NO: 902 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacactgaagctttctttggacaaggcaccagactcacagttgtaggtaagacatttttcaggttcttttgcagatccggcatgcat

SEQ ID NO: 903 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacactgaagctttctttggacaaggcaccagactcacagttgtaggtaagacatttttcaggttcttttgcagatccggcatgcat

SEQ ID NO: 904 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacactgaagctttctttggacaaggcaccagactcacagttgtaggtaagacatttttcaggttcttttgcagatccggcatgcat

SEQ ID NO: 905 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacactgaagctttctttggacaaggcaccagactcacagttgtaggtaagacatttttcaggttcttttgcagatccggcatgcat

SEQ ID NO: 906 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacactgaagctttctttggacaaggcaccagactcacagttgtaggtaagacatttttcaggttcttttgcagatccggcatgcat

SEQ ID NO: 907 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacactgaagctttctttggacaaggcaccagactcacagttgtaggtaagacatttttcaggttcttttgcagatccggcatgcat

SEQ ID NO: 908 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacactgaagctttctttggacaaggcaccagactcacagttgtaggtaagacatttttcaggttcttttgcagatccggcatgcat

SEQ ID NO: 909 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacactgaagctttctttggacaaggcaccagactcacagttgtaggtaagacatttttcaggttcttttgcagatccggcatgcat

SEQ ID NO: 910 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacactgaagctttctttggacaaggcaccagactcacagttgtaggtaagacatttttcaggttcttttgcagatccggcatgcat

SEQ ID NO: 911 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacactgaagctttctttggacaaggcaccagactcacagttgtaggtaagacatttttcaggttcttttgcagatccggcatgcat

SEQ ID NO: 912 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacactgaagctttctttggacaaggcaccagactcacagttgtaggtaagacatttttcaggttcttttgcagatccggcatgcat

SEQ ID NO: 913 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacactgaagctttctttggacaaggcaccagactcacagttgtaggtaagacatttttcaggttcttttgcagatccggcatgcat

SEQ ID NO: 914 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacactgaagctttctttggacaaggcaccagactcacagttgtaggtaagacatttttcaggttcttttgcagatccggcatgcat

SEQ ID NO: 915 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacactgaagctttctttggacaaggcaccagactcacagttgtaggtaagacatttttcaggttcttttgcagatccggcatgcat

SEQ ID NO: 916 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacactgaagctttctttggacaaggcaccagactcacagttgtaggtaagacatttttcaggttcttttgcagatccggcatgcat

SEQ ID NO: 917 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacactgaagctttctttggacaaggcaccagactcacagttgtaggtaagacatttttcaggttcttttgcagatccggcatgcat

SEQ ID NO: 918 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacactgaagctttctttggacaaggcaccagactcacagttgtaggtaagacatttttcaggttcttttgcagatccggcatgcat

SEQ ID NO: 919 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacactgaagctttctttggacaaggcaccagactcacagttgtaggtaagacatttttcaggttcttttgcagatccggcatgcat

SEQ ID NO: 920 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacactgaagctttctttggacaaggcaccagactcacagttgtaggtaagacatttttcaggttcttttgcagatccggcatgcat

SEQ ID NO: 921 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacactgaagctttctttggacaaggcaccagactcacagttgtaggtaagacatttttcaggttcttttgcagatccggcatgcat

SEQ ID NO: 922 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacactgaagctttctttggacaaggcaccagactcacagttgtaggtaagacatttttcaggttcttttgcagatccggcatgcat

SEQ ID NO: 923 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacactgaagctttctttggacaaggcaccagactcacagttgtaggtaagacatttttcaggttcttttgcagatccggcatgcat

SEQ ID NO: 924 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacactgaagctttctttggacaaggcaccagactcacagttgtaggtaagacatttttcaggttcttttgcagatccggcatgcat

SEQ ID NO: 925 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgactatggctacaccttcggttcggggaccaggttaaccgttgtaggtaaggctgggggtctctaggaggggtgcgatggcatgcat

SEQ ID NO: 926 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgactatggctacaccttcggttcggggaccaggttaaccgttgtaggtaaggctgggggtctctaggaggggtgcgatggcatgcat

SEQ ID NO: 927 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgactatggctacaccttcggttcggggaccaggttaaccgttgtaggtaaggctgggggtctctaggaggggtgcgatggcatgcat

SEQ ID NO: 928 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgactatggctacaccttcggttcggggaccaggttaaccgttgtaggtaaggctgggggtctctaggaggggtgcgatggcatgcat

SEQ ID NO: 929 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgactatggctacaccttcggttcggggaccaggttaaccgttgtaggtaaggctgggggtctctaggaggggtgcgatggcatgcat

SEQ ID NO: 930 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgactatggctacaccttcggttcggggaccaggttaaccgttgtaggtaaggctgggggtctctaggaggggtgcgatggcatgcat

SEQ ID NO: 931 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgactatggctacaccttcggttcggggaccaggttaaccgttgtaggtaaggctgggggtctctaggaggggtgcgatggcatgcat

SEQ ID NO: 932 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgactatggctacaccttcggttcggggaccaggttaaccgttgtaggtaaggctgggggtctctaggaggggtgcgatggcatgcat

SEQ ID NO: 933 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgactatggctacaccttcggttcggggaccaggttaaccgttgtaggtaaggctgggggtctctaggaggggtgcgatggcatgcat

SEQ ID NO: 934 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgactatggctacaccttcggttcggggaccaggttaaccgttgtaggtaaggctgggggtctctaggaggggtgcgatggcatgcat

SEQ ID NO: 935 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgactatggctacaccttcggttcggggaccaggttaaccgttgtaggtaaggctgggggtctctaggaggggtgcgatggcatgcat

SEQ ID NO: 936 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgactatggctacaccttcggttcggggaccaggttaaccgttgtaggtaaggctgggggtctctaggaggggtgcgatggcatgcat

SEQ ID NO: 937 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgactatggctacaccttcggttcggggaccaggttaaccgttgtaggtaaggctgggggtctctaggaggggtgcgatggcatgcat

SEQ ID NO: 938 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgactatggctacaccttcggttcggggaccaggttaaccgttgtaggtaaggctgggggtctctaggaggggtgcgatggcatgcat

SEQ ID NO: 939 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgactatggctacaccttcggttcggggaccaggttaaccgttgtaggtaaggctgggggtctctaggaggggtgcgatggcatgcat

SEQ ID NO: 940 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgactatggctacaccttcggttcggggaccaggttaaccgttgtaggtaaggctgggggtctctaggaggggtgcgatggcatgcat

SEQ ID NO: 941 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgactatggctacaccttcggttcggggaccaggttaaccgttgtaggtaaggctgggggtctctaggaggggtgcgatggcatgcat

SEQ ID NO: 942 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgactatggctacaccttcggttcggggaccaggttaaccgttgtaggtaaggctgggggtctctaggaggggtgcgatggcatgcat

SEQ ID NO: 943 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgactatggctacaccttcggttcggggaccaggttaaccgttgtaggtaaggctgggggtctctaggaggggtgcgatggcatgcat

SEQ ID NO: 944 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgactatggctacaccttcggttcggggaccaggttaaccgttgtaggtaaggctgggggtctctaggaggggtgcgatggcatgcat

SEQ ID NO: 945 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgactatggctacaccttcggttcggggaccaggttaaccgttgtaggtaaggctgggggtctctaggaggggtgcgatggcatgcat

SEQ ID NO: 946 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgactatggctacaccttcggttcggggaccaggttaaccgttgtaggtaaggctgggggtctctaggaggggtgcgatggcatgcat

SEQ ID NO: 947 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgactatggctacaccttcggttcggggaccaggttaaccgttgtaggtaaggctgggggtctctaggaggggtgcgatggcatgcat

SEQ ID NO: 948 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgactatggctacaccttcggttcggggaccaggttaaccgttgtaggtaaggctgggggtctctaggaggggtgcgatggcatgcat

SEQ ID NO: 949 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgactatggctacaccttcggttcggggaccaggttaaccgttgtaggtaaggctgggggtctctaggaggggtgcgatggcatgcat

SEQ ID NO: 950 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgactatggctacaccttcggttcggggaccaggttaaccgttgtaggtaaggctgggggtctctaggaggggtgcgatggcatgcat

SEQ ID NO: 951 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgactatggctacaccttcggttcggggaccaggttaaccgttgtaggtaaggctgggggtctctaggaggggtgcgatggcatgcat

SEQ ID NO: 952 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgactatggctacaccttcggttcggggaccaggttaaccgttgtaggtaaggctgggggtctctaggaggggtgcgatggcatgcat

SEQ ID NO: 953 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgactatggctacaccttcggttcggggaccaggttaaccgttgtaggtaaggctgggggtctctaggaggggtgcgatggcatgcat

SEQ ID NO: 954 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgactatggctacaccttcggttcggggaccaggttaaccgttgtaggtaaggctgggggtctctaggaggggtgcgatggcatgcat

SEQ ID NO: 955 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgactatggctacaccttcggttcggggaccaggttaaccgttgtaggtaaggctgggggtctctaggaggggtgcgatggcatgcat

SEQ ID NO: 956 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgactatggctacaccttcggttcggggaccaggttaaccgttgtaggtaaggctgggggtctctaggaggggtgcgatggcatgcat

SEQ ID NO: 957 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgactatggctacaccttcggttcggggaccaggttaaccgttgtaggtaaggctgggggtctctaggaggggtgcgatggcatgcat

SEQ ID NO: 958 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgactatggctacaccttcggttcggggaccaggttaaccgttgtaggtaaggctgggggtctctaggaggggtgcgatggcatgcat

SEQ ID NO: 959 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgactatggctacaccttcggttcggggaccaggttaaccgttgtaggtaaggctgggggtctctaggaggggtgcgatggcatgcat

SEQ ID NO: 960 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgactatggctacaccttcggttcggggaccaggttaaccgttgtaggtaaggctgggggtctctaggaggggtgcgatggcatgcat

SEQ ID NO: 961 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgactatggctacaccttcggttcggggaccaggttaaccgttgtaggtaaggctgggggtctctaggaggggtgcgatggcatgcat

SEQ ID NO: 962 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgactatggctacaccttcggttcggggaccaggttaaccgttgtaggtaaggctgggggtctctaggaggggtgcgatggcatgcat

SEQ ID NO: 963 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgactatggctacaccttcggttcggggaccaggttaaccgttgtaggtaaggctgggggtctctaggaggggtgcgatggcatgcat

SEQ ID NO: 964 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgactatggctacaccttcggttcggggaccaggttaaccgttgtaggtaaggctgggggtctctaggaggggtgcgatggcatgcat

SEQ ID NO: 965 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgactatggctacaccttcggttcggggaccaggttaaccgttgtaggtaaggctgggggtctctaggaggggtgcgatggcatgcat

SEQ ID NO: 966 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgactatggctacaccttcggttcggggaccaggttaaccgttgtaggtaaggctgggggtctctaggaggggtgcgatggcatgcat

SEQ ID NO: 967 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgactatggctacaccttcggttcggggaccaggttaaccgttgtaggtaaggctgggggtctctaggaggggtgcgatggcatgcat

SEQ ID NO: 968 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgactatggctacaccttcggttcggggaccaggttaaccgttgtaggtaaggctgggggtctctaggaggggtgcgatggcatgcat

SEQ ID NO: 969 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgactatggctacaccttcggttcggggaccaggttaaccgttgtaggtaaggctgggggtctctaggaggggtgcgatggcatgcat

SEQ ID NO: 970 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgactatggctacaccttcggttcggggaccaggttaaccgttgtaggtaaggctgggggtctctaggaggggtgcgatggcatgcat

SEQ ID NO: 971 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgactatggctacaccttcggttcggggaccaggttaaccgttgtaggtaaggctgggggtctctaggaggggtgcgatggcatgcat

SEQ ID NO: 972 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgactatggctacaccttcggttcggggaccaggttaaccgttgtaggtaaggctgggggtctctaggaggggtgcgatggcatgcat

SEQ ID NO: 973 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgactatggctacaccttcggttcggggaccaggttaaccgttgtaggtaaggctgggggtctctaggaggggtgcgatggcatgcat

SEQ ID NO: 974 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgactatggctacaccttcggttcggggaccaggttaaccgttgtaggtaaggctgggggtctctaggaggggtgcgatggcatgcat

SEQ ID NO: 975 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgactatggctacaccttcggttcggggaccaggttaaccgttgtaggtaaggctgggggtctctaggaggggtgcgatggcatgcat

SEQ ID NO: 976 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgactatggctacaccttcggttcggggaccaggttaaccgttgtaggtaaggctgggggtctctaggaggggtgcgatggcatgcat

SEQ ID NO: 977 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgactatggctacaccttcggttcggggaccaggttaaccgttgtaggtaaggctgggggtctctaggaggggtgcgatggcatgcat

SEQ ID NO: 978 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacgaaacaccatatattttggagagggaagttggctcactgttgtaggtgagtaagtcaaggctggacagctgggaacgcatgcat

SEQ ID NO: 979 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacgaaacaccatatattttggagagggaagttggctcactgttgtaggtgagtaagtcaaggctggacagctgggaacgcatgcat

SEQ ID NO: 980 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacgaaacaccatatattttggagagggaagttggctcactgttgtaggtgagtaagtcaaggctggacagctgggaacgcatgcat

SEQ ID NO: 981 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacgaaacaccatatattttggagagggaagttggctcactgttgtaggtgagtaagtcaaggctggacagctgggaacgcatgcat

SEQ ID NO: 982 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacgaaacaccatatattttggagagggaagttggctcactgttgtaggtgagtaagtcaaggctggacagctgggaacgcatgcat

SEQ ID NO: 983 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacgaaacaccatatattttggagagggaagttggctcactgttgtaggtgagtaagtcaaggctggacagctgggaacgcatgcat

SEQ ID NO: 984 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacgaaacaccatatattttggagagggaagttggctcactgttgtaggtgagtaagtcaaggctggacagctgggaacgcatgcat

SEQ ID NO: 985 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacgaaacaccatatattttggagagggaagttggctcactgttgtaggtgagtaagtcaaggctggacagctgggaacgcatgcat

SEQ ID NO: 986 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacgaaacaccatatattttggagagggaagttggctcactgttgtaggtgagtaagtcaaggctggacagctgggaacgcatgcat

SEQ ID NO: 987 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacgaaacaccatatattttggagagggaagttggctcactgttgtaggtgagtaagtcaaggctggacagctgggaacgcatgcat

SEQ ID NO: 988 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacgaaacaccatatattttggagagggaagttggctcactgttgtaggtgagtaagtcaaggctggacagctgggaacgcatgcat

SEQ ID NO: 989 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacgaaacaccatatattttggagagggaagttggctcactgttgtaggtgagtaagtcaaggctggacagctgggaacgcatgcat

SEQ ID NO: 990 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacgaaacaccatatattttggagagggaagttggctcactgttgtaggtgagtaagtcaaggctggacagctgggaacgcatgcat

SEQ ID NO: 991 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacgaaacaccatatattttggagagggaagttggctcactgttgtaggtgagtaagtcaaggctggacagctgggaacgcatgcat

SEQ ID NO: 992 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacgaaacaccatatattttggagagggaagttggctcactgttgtaggtgagtaagtcaaggctggacagctgggaacgcatgcat

SEQ ID NO: 993 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacgaaacaccatatattttggagagggaagttggctcactgttgtaggtgagtaagtcaaggctggacagctgggaacgcatgcat

SEQ ID NO: 994 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacgaaacaccatatattttggagagggaagttggctcactgttgtaggtgagtaagtcaaggctggacagctgggaacgcatgcat

SEQ ID NO: 995 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacgaaacaccatatattttggagagggaagttggctcactgttgtaggtgagtaagtcaaggctggacagctgggaacgcatgcat

SEQ ID NO: 996 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacgaaacaccatatattttggagagggaagttggctcactgttgtaggtgagtaagtcaaggctggacagctgggaacgcatgcat

SEQ ID NO: 997 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacgaaacaccatatattttggagagggaagttggctcactgttgtaggtgagtaagtcaaggctggacagctgggaacgcatgcat

SEQ ID NO: 998 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacgaaacaccatatattttggagagggaagttggctcactgttgtaggtgagtaagtcaaggctggacagctgggaacgcatgcat

SEQ ID NO: 999 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacgaaacaccatatattttggagagggaagttggctcactgttgtaggtgagtaagtcaaggctggacagctgggaacgcatgcat

SEQ ID NO: 1000 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacgaaacaccatatattttggagagggaagttggctcactgttgtaggtgagtaagtcaaggctggacagctgggaacgcatgcat

SEQ ID NO: 1001 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacgaaacaccatatattttggagagggaagttggctcactgttgtaggtgagtaagtcaaggctggacagctgggaacgcatgcat

SEQ ID NO: 1002 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacgaaacaccatatattttggagagggaagttggctcactgttgtaggtgagtaagtcaaggctggacagctgggaacgcatgcat

SEQ ID NO: 1003 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacgaaacaccatatattttggagagggaagttggctcactgttgtaggtgagtaagtcaaggctggacagctgggaacgcatgcat

SEQ ID NO: 1004 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacgaaacaccatatattttggagagggaagttggctcactgttgtaggtgagtaagtcaaggctggacagctgggaacgcatgcat

SEQ ID NO: 1005 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacgaaacaccatatattttggagagggaagttggctcactgttgtaggtgagtaagtcaaggctggacagctgggaacgcatgcat

SEQ ID NO: 1006 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacgaaacaccatatattttggagagggaagttggctcactgttgtaggtgagtaagtcaaggctggacagctgggaacgcatgcat

SEQ ID NO: 1007 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacgaaacaccatatattttggagagggaagttggctcactgttgtaggtgagtaagtcaaggctggacagctgggaacgcatgcat

SEQ ID NO: 1008 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacgaaacaccatatattttggagagggaagttggctcactgttgtaggtgagtaagtcaaggctggacagctgggaacgcatgcat

SEQ ID NO: 1009 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacgaaacaccatatattttggagagggaagttggctcactgttgtaggtgagtaagtcaaggctggacagctgggaacgcatgcat

SEQ ID NO: 1010 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacgaaacaccatatattttggagagggaagttggctcactgttgtaggtgagtaagtcaaggctggacagctgggaacgcatgcat

SEQ ID NO: 1011 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacgaaacaccatatattttggagagggaagttggctcactgttgtaggtgagtaagtcaaggctggacagctgggaacgcatgcat

SEQ ID NO: 1012 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacgaaacaccatatattttggagagggaagttggctcactgttgtaggtgagtaagtcaaggctggacagctgggaacgcatgcat

SEQ ID NO: 1013 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacgaaacaccatatattttggagagggaagttggctcactgttgtaggtgagtaagtcaaggctggacagctgggaacgcatgcat

SEQ ID NO: 1014 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacgaaacaccatatattttggagagggaagttggctcactgttgtaggtgagtaagtcaaggctggacagctgggaacgcatgcat

SEQ ID NO: 1015 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacgaaacaccatatattttggagagggaagttggctcactgttgtaggtgagtaagtcaaggctggacagctgggaacgcatgcat

SEQ ID NO: 1016 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacgaaacaccatatattttggagagggaagttggctcactgttgtaggtgagtaagtcaaggctggacagctgggaacgcatgcat

SEQ ID NO: 1017 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacgaaacaccatatattttggagagggaagttggctcactgttgtaggtgagtaagtcaaggctggacagctgggaacgcatgcat

SEQ ID NO: 1018 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacgaaacaccatatattttggagagggaagttggctcactgttgtaggtgagtaagtcaaggctggacagctgggaacgcatgcat

SEQ ID NO: 1019 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacgaaacaccatatattttggagagggaagttggctcactgttgtaggtgagtaagtcaaggctggacagctgggaacgcatgcat

SEQ ID NO: 1020 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacgaaacaccatatattttggagagggaagttggctcactgttgtaggtgagtaagtcaaggctggacagctgggaacgcatgcat

SEQ ID NO: 1021 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacgaaacaccatatattttggagagggaagttggctcactgttgtaggtgagtaagtcaaggctggacagctgggaacgcatgcat

SEQ ID NO: 1022 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacgaaacaccatatattttggagagggaagttggctcactgttgtaggtgagtaagtcaaggctggacagctgggaacgcatgcat

SEQ ID NO: 1023 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacgaaacaccatatattttggagagggaagttggctcactgttgtaggtgagtaagtcaaggctggacagctgggaacgcatgcat

SEQ ID NO: 1024 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacgaaacaccatatattttggagagggaagttggctcactgttgtaggtgagtaagtcaaggctggacagctgggaacgcatgcat

SEQ ID NO: 1025 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacgaaacaccatatattttggagagggaagttggctcactgttgtaggtgagtaagtcaaggctggacagctgggaacgcatgcat

SEQ ID NO: 1026 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacgaaacaccatatattttggagagggaagttggctcactgttgtaggtgagtaagtcaaggctggacagctgggaacgcatgcat

SEQ ID NO: 1027 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacgaaacaccatatattttggagagggaagttggctcactgttgtaggtgagtaagtcaaggctggacagctgggaacgcatgcat

SEQ ID NO: 1028 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacgaaacaccatatattttggagagggaagttggctcactgttgtaggtgagtaagtcaaggctggacagctgggaacgcatgcat

SEQ ID NO: 1029 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacgaaacaccatatattttggagagggaagttggctcactgttgtaggtgagtaagtcaaggctggacagctgggaacgcatgcat

SEQ ID NO: 1030 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacgaaacaccatatattttggagagggaagttggctcactgttgtaggtgagtaagtcaaggctggacagctgggaacgcatgcat

SEQ ID NO: 1031 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacaatgaaaaactgttttttggcagtggaacccagctctctgtcttgggtatgtaaaagacttctttcgggatagtgtgcatgcat

SEQ ID NO: 1032 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacaatgaaaaactgttttttggcagtggaacccagctctctgtcttgggtatgtaaaagacttctttcgggatagtgtgcatgcat

SEQ ID NO: 1033 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacaatgaaaaactgttttttggcagtggaacccagctctctgtcttgggtatgtaaaagacttctttcgggatagtgtgcatgcat

SEQ ID NO: 1034 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacaatgaaaaactgttttttggcagtggaacccagctctctgtcttgggtatgtaaaagacttctttcgggatagtgtgcatgcat

SEQ ID NO: 1035 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacaatgaaaaactgttttttggcagtggaacccagctctctgtcttgggtatgtaaaagacttctttcgggatagtgtgcatgcat

SEQ ID NO: 1036 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacaatgaaaaactgttttttggcagtggaacccagctctctgtcttgggtatgtaaaagacttctttcgggatagtgtgcatgcat

SEQ ID NO: 1037 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacaatgaaaaactgttttttggcagtggaacccagctctctgtcttgggtatgtaaaagacttctttcgggatagtgtgcatgcat

SEQ ID NO: 1038 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacaatgaaaaactgttttttggcagtggaacccagctctctgtcttgggtatgtaaaagacttctttcgggatagtgtgcatgcat

SEQ ID NO: 1039 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacaatgaaaaactgttttttggcagtggaacccagctctctgtcttgggtatgtaaaagacttctttcgggatagtgtgcatgcat

SEQ ID NO: 1040 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacaatgaaaaactgttttttggcagtggaacccagctctctgtcttgggtatgtaaaagacttctttcgggatagtgtgcatgcat

SEQ ID NO: 1041 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacaatgaaaaactgttttttggcagtggaacccagctctctgtcttgggtatgtaaaagacttctttcgggatagtgtgcatgcat

SEQ ID NO: 1042 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacaatgaaaaactgttttttggcagtggaacccagctctctgtcttgggtatgtaaaagacttctttcgggatagtgtgcatgcat

SEQ ID NO: 1043 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacaatgaaaaactgttttttggcagtggaacccagctctctgtcttgggtatgtaaaagacttctttcgggatagtgtgcatgcat

SEQ ID NO: 1044 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacaatgaaaaactgttttttggcagtggaacccagctctctgtcttgggtatgtaaaagacttctttcgggatagtgtgcatgcat

SEQ ID NO: 1045 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacaatgaaaaactgttttttggcagtggaacccagctctctgtcttgggtatgtaaaagacttctttcgggatagtgtgcatgcat

SEQ ID NO: 1046 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacaatgaaaaactgttttttggcagtggaacccagctctctgtcttgggtatgtaaaagacttctttcgggatagtgtgcatgcat

SEQ ID NO: 1047 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacaatgaaaaactgttttttggcagtggaacccagctctctgtcttgggtatgtaaaagacttctttcgggatagtgtgcatgcat

SEQ ID NO: 1048 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacaatgaaaaactgttttttggcagtggaacccagctctctgtcttgggtatgtaaaagacttctttcgggatagtgtgcatgcat

SEQ ID NO: 1049 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacaatgaaaaactgttttttggcagtggaacccagctctctgtcttgggtatgtaaaagacttctttcgggatagtgtgcatgcat

SEQ ID NO: 1050 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacaatgaaaaactgttttttggcagtggaacccagctctctgtcttgggtatgtaaaagacttctttcgggatagtgtgcatgcat

SEQ ID NO: 1051 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacaatgaaaaactgttttttggcagtggaacccagctctctgtcttgggtatgtaaaagacttctttcgggatagtgtgcatgcat

SEQ ID NO: 1052 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacaatgaaaaactgttttttggcagtggaacccagctctctgtcttgggtatgtaaaagacttctttcgggatagtgtgcatgcat

SEQ ID NO: 1053 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacaatgaaaaactgttttttggcagtggaacccagctctctgtcttgggtatgtaaaagacttctttcgggatagtgtgcatgcat

SEQ ID NO: 1054 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacaatgaaaaactgttttttggcagtggaacccagctctctgtcttgggtatgtaaaagacttctttcgggatagtgtgcatgcat

SEQ ID NO: 1055 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacaatgaaaaactgttttttggcagtggaacccagctctctgtcttgggtatgtaaaagacttctttcgggatagtgtgcatgcat

SEQ ID NO: 1056 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacaatgaaaaactgttttttggcagtggaacccagctctctgtcttgggtatgtaaaagacttctttcgggatagtgtgcatgcat

SEQ ID NO: 1057 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacaatgaaaaactgttttttggcagtggaacccagctctctgtcttgggtatgtaaaagacttctttcgggatagtgtgcatgcat

SEQ ID NO: 1058 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacaatgaaaaactgttttttggcagtggaacccagctctctgtcttgggtatgtaaaagacttctttcgggatagtgtgcatgcat

SEQ ID NO: 1059 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacaatgaaaaactgttttttggcagtggaacccagctctctgtcttgggtatgtaaaagacttctttcgggatagtgtgcatgcat

SEQ ID NO: 1060 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacaatgaaaaactgttttttggcagtggaacccagctctctgtcttgggtatgtaaaagacttctttcgggatagtgtgcatgcat

SEQ ID NO: 1061 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacaatgaaaaactgttttttggcagtggaacccagctctctgtcttgggtatgtaaaagacttctttcgggatagtgtgcatgcat

SEQ ID NO: 1062 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacaatgaaaaactgttttttggcagtggaacccagctctctgtcttgggtatgtaaaagacttctttcgggatagtgtgcatgcat

SEQ ID NO: 1063 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacaatgaaaaactgttttttggcagtggaacccagctctctgtcttgggtatgtaaaagacttctttcgggatagtgtgcatgcat

SEQ ID NO: 1064 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacaatgaaaaactgttttttggcagtggaacccagctctctgtcttgggtatgtaaaagacttctttcgggatagtgtgcatgcat

SEQ ID NO: 1065 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacaatgaaaaactgttttttggcagtggaacccagctctctgtcttgggtatgtaaaagacttctttcgggatagtgtgcatgcat

SEQ ID NO: 1066 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacaatgaaaaactgttttttggcagtggaacccagctctctgtcttgggtatgtaaaagacttctttcgggatagtgtgcatgcat

SEQ ID NO: 1067 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacaatgaaaaactgttttttggcagtggaacccagctctctgtcttgggtatgtaaaagacttctttcgggatagtgtgcatgcat

SEQ ID NO: 1068 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacaatgaaaaactgttttttggcagtggaacccagctctctgtcttgggtatgtaaaagacttctttcgggatagtgtgcatgcat

SEQ ID NO: 1069 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacaatgaaaaactgttttttggcagtggaacccagctctctgtcttgggtatgtaaaagacttctttcgggatagtgtgcatgcat

SEQ ID NO: 1070 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacaatgaaaaactgttttttggcagtggaacccagctctctgtcttgggtatgtaaaagacttctttcgggatagtgtgcatgcat

SEQ ID NO: 1071 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacaatgaaaaactgttttttggcagtggaacccagctctctgtcttgggtatgtaaaagacttctttcgggatagtgtgcatgcat

SEQ ID NO: 1072 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacaatgaaaaactgttttttggcagtggaacccagctctctgtcttgggtatgtaaaagacttctttcgggatagtgtgcatgcat

SEQ ID NO: 1073 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacaatgaaaaactgttttttggcagtggaacccagctctctgtcttgggtatgtaaaagacttctttcgggatagtgtgcatgcat

SEQ ID NO: 1074 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacaatgaaaaactgttttttggcagtggaacccagctctctgtcttgggtatgtaaaagacttctttcgggatagtgtgcatgcat

SEQ ID NO: 1075 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacaatgaaaaactgttttttggcagtggaacccagctctctgtcttgggtatgtaaaagacttctttcgggatagtgtgcatgcat

SEQ ID NO: 1076 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacaatgaaaaactgttttttggcagtggaacccagctctctgtcttgggtatgtaaaagacttctttcgggatagtgtgcatgcat

SEQ ID NO: 1077 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacaatgaaaaactgttttttggcagtggaacccagctctctgtcttgggtatgtaaaagacttctttcgggatagtgtgcatgcat

SEQ ID NO: 1078 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacaatgaaaaactgttttttggcagtggaacccagctctctgtcttgggtatgtaaaagacttctttcgggatagtgtgcatgcat

SEQ ID NO: 1079 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacaatgaaaaactgttttttggcagtggaacccagctctctgtcttgggtatgtaaaagacttctttcgggatagtgtgcatgcat

SEQ ID NO: 1080 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacaatgaaaaactgttttttggcagtggaacccagctctctgtcttgggtatgtaaaagacttctttcgggatagtgtgcatgcat

SEQ ID NO: 1081 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacaatgaaaaactgttttttggcagtggaacccagctctctgtcttgggtatgtaaaagacttctttcgggatagtgtgcatgcat

SEQ ID NO: 1082 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacaatgaaaaactgttttttggcagtggaacccagctctctgtcttgggtatgtaaaagacttctttcgggatagtgtgcatgcat

SEQ ID NO: 1083 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacaatgaaaaactgttttttggcagtggaacccagctctctgtcttgggtatgtaaaagacttctttcgggatagtgtgcatgcat

SEQ ID NO: 1084 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacatcagccccagcattttggtgatgggactcgactctccatcctaggtaagttgcagaatcagggtggtatggccatgcatgcat

SEQ ID NO: 1085 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacatcagccccagcattttggtgatgggactcgactctccatcctaggtaagttgcagaatcagggtggtatggccatgcatgcat

SEQ ID NO: 1086 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacatcagccccagcattttggtgatgggactcgactctccatcctaggtaagttgcagaatcagggtggtatggccatgcatgcat

SEQ ID NO: 1087 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacatcagccccagcattttggtgatgggactcgactctccatcctaggtaagttgcagaatcagggtggtatggccatgcatgcat

SEQ ID NO: 1088 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacatcagccccagcattttggtgatgggactcgactctccatcctaggtaagttgcagaatcagggtggtatggccatgcatgcat

SEQ ID NO: 1089 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacatcagccccagcattttggtgatgggactcgactctccatcctaggtaagttgcagaatcagggtggtatggccatgcatgcat

SEQ ID NO: 1090 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacatcagccccagcattttggtgatgggactcgactctccatcctaggtaagttgcagaatcagggtggtatggccatgcatgcat

SEQ ID NO: 1091 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacatcagccccagcattttggtgatgggactcgactctccatcctaggtaagttgcagaatcagggtggtatggccatgcatgcat

SEQ ID NO: 1092 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacatcagccccagcattttggtgatgggactcgactctccatcctaggtaagttgcagaatcagggtggtatggccatgcatgcat

SEQ ID NO: 1093 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacatcagccccagcattttggtgatgggactcgactctccatcctaggtaagttgcagaatcagggtggtatggccatgcatgcat

SEQ ID NO: 1094 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacatcagccccagcattttggtgatgggactcgactctccatcctaggtaagttgcagaatcagggtggtatggccatgcatgcat

SEQ ID NO: 1095 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacatcagccccagcattttggtgatgggactcgactctccatcctaggtaagttgcagaatcagggtggtatggccatgcatgcat

SEQ ID NO: 1096 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacatcagccccagcattttggtgatgggactcgactctccatcctaggtaagttgcagaatcagggtggtatggccatgcatgcat

SEQ ID NO: 1097 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacatcagccccagcattttggtgatgggactcgactctccatcctaggtaagttgcagaatcagggtggtatggccatgcatgcat

SEQ ID NO: 1098 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacatcagccccagcattttggtgatgggactcgactctccatcctaggtaagttgcagaatcagggtggtatggccatgcatgcat

SEQ ID NO: 1099 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacatcagccccagcattttggtgatgggactcgactctccatcctaggtaagttgcagaatcagggtggtatggccatgcatgcat

SEQ ID NO: 1100 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacatcagccccagcattttggtgatgggactcgactctccatcctaggtaagttgcagaatcagggtggtatggccatgcatgcat

SEQ ID NO: 1101 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacatcagccccagcattttggtgatgggactcgactctccatcctaggtaagttgcagaatcagggtggtatggccatgcatgcat

SEQ ID NO: 1102 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacatcagccccagcattttggtgatgggactcgactctccatcctaggtaagttgcagaatcagggtggtatggccatgcatgcat

SEQ ID NO: 1103 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacatcagccccagcattttggtgatgggactcgactctccatcctaggtaagttgcagaatcagggtggtatggccatgcatgcat

SEQ ID NO: 1104 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacatcagccccagcattttggtgatgggactcgactctccatcctaggtaagttgcagaatcagggtggtatggccatgcatgcat

SEQ ID NO: 1105 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacatcagccccagcattttggtgatgggactcgactctccatcctaggtaagttgcagaatcagggtggtatggccatgcatgcat

SEQ ID NO: 1106 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacatcagccccagcattttggtgatgggactcgactctccatcctaggtaagttgcagaatcagggtggtatggccatgcatgcat

SEQ ID NO: 1107 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacatcagccccagcattttggtgatgggactcgactctccatcctaggtaagttgcagaatcagggtggtatggccatgcatgcat

SEQ ID NO: 1108 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacatcagccccagcattttggtgatgggactcgactctccatcctaggtaagttgcagaatcagggtggtatggccatgcatgcat

SEQ ID NO: 1109 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacatcagccccagcattttggtgatgggactcgactctccatcctaggtaagttgcagaatcagggtggtatggccatgcatgcat

SEQ ID NO: 1110 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacatcagccccagcattttggtgatgggactcgactctccatcctaggtaagttgcagaatcagggtggtatggccatgcatgcat

SEQ ID NO: 1111 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacatcagccccagcattttggtgatgggactcgactctccatcctaggtaagttgcagaatcagggtggtatggccatgcatgcat

SEQ ID NO: 1112 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacatcagccccagcattttggtgatgggactcgactctccatcctaggtaagttgcagaatcagggtggtatggccatgcatgcat

SEQ ID NO: 1113 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacatcagccccagcattttggtgatgggactcgactctccatcctaggtaagttgcagaatcagggtggtatggccatgcatgcat

SEQ ID NO: 1114 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacatcagccccagcattttggtgatgggactcgactctccatcctaggtaagttgcagaatcagggtggtatggccatgcatgcat

SEQ ID NO: 1115 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacatcagccccagcattttggtgatgggactcgactctccatcctaggtaagttgcagaatcagggtggtatggccatgcatgcat

SEQ ID NO: 1116 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacatcagccccagcattttggtgatgggactcgactctccatcctaggtaagttgcagaatcagggtggtatggccatgcatgcat

SEQ ID NO: 1117 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacatcagccccagcattttggtgatgggactcgactctccatcctaggtaagttgcagaatcagggtggtatggccatgcatgcat

SEQ ID NO: 1118 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacatcagccccagcattttggtgatgggactcgactctccatcctaggtaagttgcagaatcagggtggtatggccatgcatgcat

SEQ ID NO: 1119 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacatcagccccagcattttggtgatgggactcgactctccatcctaggtaagttgcagaatcagggtggtatggccatgcatgcat

SEQ ID NO: 1120 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacatcagccccagcattttggtgatgggactcgactctccatcctaggtaagttgcagaatcagggtggtatggccatgcatgcat

SEQ ID NO: 1121 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacatcagccccagcattttggtgatgggactcgactctccatcctaggtaagttgcagaatcagggtggtatggccatgcatgcat

SEQ ID NO: 1122 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacatcagccccagcattttggtgatgggactcgactctccatcctaggtaagttgcagaatcagggtggtatggccatgcatgcat

SEQ ID NO: 1123 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacatcagccccagcattttggtgatgggactcgactctccatcctaggtaagttgcagaatcagggtggtatggccatgcatgcat

SEQ ID NO: 1124 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacatcagccccagcattttggtgatgggactcgactctccatcctaggtaagttgcagaatcagggtggtatggccatgcatgcat

SEQ ID NO: 1125 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacatcagccccagcattttggtgatgggactcgactctccatcctaggtaagttgcagaatcagggtggtatggccatgcatgcat

SEQ ID NO: 1126 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacatcagccccagcattttggtgatgggactcgactctccatcctaggtaagttgcagaatcagggtggtatggccatgcatgcat

SEQ ID NO: 1127 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacatcagccccagcattttggtgatgggactcgactctccatcctaggtaagttgcagaatcagggtggtatggccatgcatgcat

SEQ ID NO: 1128 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacatcagccccagcattttggtgatgggactcgactctccatcctaggtaagttgcagaatcagggtggtatggccatgcatgcat

SEQ ID NO: 1129 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacatcagccccagcattttggtgatgggactcgactctccatcctaggtaagttgcagaatcagggtggtatggccatgcatgcat

SEQ ID NO: 1130 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacatcagccccagcattttggtgatgggactcgactctccatcctaggtaagttgcagaatcagggtggtatggccatgcatgcat

SEQ ID NO: 1131 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacatcagccccagcattttggtgatgggactcgactctccatcctaggtaagttgcagaatcagggtggtatggccatgcatgcat

SEQ ID NO: 1132 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacatcagccccagcattttggtgatgggactcgactctccatcctaggtaagttgcagaatcagggtggtatggccatgcatgcat

SEQ ID NO: 1133 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacatcagccccagcattttggtgatgggactcgactctccatcctaggtaagttgcagaatcagggtggtatggccatgcatgcat

SEQ ID NO: 1134 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacatcagccccagcattttggtgatgggactcgactctccatcctaggtaagttgcagaatcagggtggtatggccatgcatgcat

SEQ ID NO: 1135 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacatcagccccagcattttggtgatgggactcgactctccatcctaggtaagttgcagaatcagggtggtatggccatgcatgcat

SEQ ID NO: 1136 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacatcagccccagcattttggtgatgggactcgactctccatcctaggtaagttgcagaatcagggtggtatggccatgcatgcat

SEQ ID NO: 1137 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacataattcacccctccactttgggaacgggaccaggctcactgtgacaggtatgggggctccactcttgactcgggggcatgcat

SEQ ID NO: 1138 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacataattcacccctccactttgggaacgggaccaggctcactgtgacaggtatgggggctccactcttgactcgggggcatgcat

SEQ ID NO: 1139 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacataattcacccctccactttgggaacgggaccaggctcactgtgacaggtatgggggctccactcttgactcgggggcatgcat

SEQ ID NO: 1140 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacataattcacccctccactttgggaacgggaccaggctcactgtgacaggtatgggggctccactcttgactcgggggcatgcat

SEQ ID NO: 1141 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacataattcacccctccactttgggaacgggaccaggctcactgtgacaggtatgggggctccactcttgactcgggggcatgcat

SEQ ID NO: 1142 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacataattcacccctccactttgggaacgggaccaggctcactgtgacaggtatgggggctccactcttgactcgggggcatgcat

SEQ ID NO: 1143 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacataattcacccctccactttgggaacgggaccaggctcactgtgacaggtatgggggctccactcttgactcgggggcatgcat

SEQ ID NO: 1144 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacataattcacccctccactttgggaacgggaccaggctcactgtgacaggtatgggggctccactcttgactcgggggcatgcat

SEQ ID NO: 1145 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacataattcacccctccactttgggaacgggaccaggctcactgtgacaggtatgggggctccactcttgactcgggggcatgcat

SEQ ID NO: 1146 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacataattcacccctccactttgggaacgggaccaggctcactgtgacaggtatgggggctccactcttgactcgggggcatgcat

SEQ ID NO: 1147 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacataattcacccctccactttgggaacgggaccaggctcactgtgacaggtatgggggctccactcttgactcgggggcatgcat

SEQ ID NO: 1148 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacataattcacccctccactttgggaacgggaccaggctcactgtgacaggtatgggggctccactcttgactcgggggcatgcat

SEQ ID NO: 1149 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacataattcacccctccactttgggaacgggaccaggctcactgtgacaggtatgggggctccactcttgactcgggggcatgcat

SEQ ID NO: 1150 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacataattcacccctccactttgggaacgggaccaggctcactgtgacaggtatgggggctccactcttgactcgggggcatgcat

SEQ ID NO: 1151 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacataattcacccctccactttgggaacgggaccaggctcactgtgacaggtatgggggctccactcttgactcgggggcatgcat

SEQ ID NO: 1152 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacataattcacccctccactttgggaacgggaccaggctcactgtgacaggtatgggggctccactcttgactcgggggcatgcat

SEQ ID NO: 1153 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacataattcacccctccactttgggaacgggaccaggctcactgtgacaggtatgggggctccactcttgactcgggggcatgcat

SEQ ID NO: 1154 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacataattcacccctccactttgggaacgggaccaggctcactgtgacaggtatgggggctccactcttgactcgggggcatgcat

SEQ ID NO: 1155 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacataattcacccctccactttgggaacgggaccaggctcactgtgacaggtatgggggctccactcttgactcgggggcatgcat

SEQ ID NO: 1156 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacataattcacccctccactttgggaacgggaccaggctcactgtgacaggtatgggggctccactcttgactcgggggcatgcat

SEQ ID NO: 1157 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacataattcacccctccactttgggaacgggaccaggctcactgtgacaggtatgggggctccactcttgactcgggggcatgcat

SEQ ID NO: 1158 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacataattcacccctccactttgggaacgggaccaggctcactgtgacaggtatgggggctccactcttgactcgggggcatgcat

SEQ ID NO: 1159 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacataattcacccctccactttgggaacgggaccaggctcactgtgacaggtatgggggctccactcttgactcgggggcatgcat

SEQ ID NO: 1160 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacataattcacccctccactttgggaacgggaccaggctcactgtgacaggtatgggggctccactcttgactcgggggcatgcat

SEQ ID NO: 1161 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacataattcacccctccactttgggaacgggaccaggctcactgtgacaggtatgggggctccactcttgactcgggggcatgcat

SEQ ID NO: 1162 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacataattcacccctccactttgggaacgggaccaggctcactgtgacaggtatgggggctccactcttgactcgggggcatgcat

SEQ ID NO: 1163 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacataattcacccctccactttgggaacgggaccaggctcactgtgacaggtatgggggctccactcttgactcgggggcatgcat

SEQ ID NO: 1164 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacataattcacccctccactttgggaacgggaccaggctcactgtgacaggtatgggggctccactcttgactcgggggcatgcat

SEQ ID NO: 1165 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacataattcacccctccactttgggaacgggaccaggctcactgtgacaggtatgggggctccactcttgactcgggggcatgcat

SEQ ID NO: 1166 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacataattcacccctccactttgggaacgggaccaggctcactgtgacaggtatgggggctccactcttgactcgggggcatgcat

SEQ ID NO: 1167 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacataattcacccctccactttgggaacgggaccaggctcactgtgacaggtatgggggctccactcttgactcgggggcatgcat

SEQ ID NO: 1168 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacataattcacccctccactttgggaacgggaccaggctcactgtgacaggtatgggggctccactcttgactcgggggcatgcat

SEQ ID NO: 1169 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacataattcacccctccactttgggaacgggaccaggctcactgtgacaggtatgggggctccactcttgactcgggggcatgcat

SEQ ID NO: 1170 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacataattcacccctccactttgggaacgggaccaggctcactgtgacaggtatgggggctccactcttgactcgggggcatgcat

SEQ ID NO: 1171 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacataattcacccctccactttgggaacgggaccaggctcactgtgacaggtatgggggctccactcttgactcgggggcatgcat

SEQ ID NO: 1172 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacataattcacccctccactttgggaacgggaccaggctcactgtgacaggtatgggggctccactcttgactcgggggcatgcat

SEQ ID NO: 1173 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacataattcacccctccactttgggaacgggaccaggctcactgtgacaggtatgggggctccactcttgactcgggggcatgcat

SEQ ID NO: 1174 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacataattcacccctccactttgggaacgggaccaggctcactgtgacaggtatgggggctccactcttgactcgggggcatgcat

SEQ ID NO: 1175 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacataattcacccctccactttgggaacgggaccaggctcactgtgacaggtatgggggctccactcttgactcgggggcatgcat

SEQ ID NO: 1176 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacataattcacccctccactttgggaacgggaccaggctcactgtgacaggtatgggggctccactcttgactcgggggcatgcat

SEQ ID NO: 1177 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacataattcacccctccactttgggaacgggaccaggctcactgtgacaggtatgggggctccactcttgactcgggggcatgcat

SEQ ID NO: 1178 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacataattcacccctccactttgggaacgggaccaggctcactgtgacaggtatgggggctccactcttgactcgggggcatgcat

SEQ ID NO: 1179 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacataattcacccctccactttgggaacgggaccaggctcactgtgacaggtatgggggctccactcttgactcgggggcatgcat

SEQ ID NO: 1180 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacataattcacccctccactttgggaacgggaccaggctcactgtgacaggtatgggggctccactcttgactcgggggcatgcat

SEQ ID NO: 1181 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacataattcacccctccactttgggaacgggaccaggctcactgtgacaggtatgggggctccactcttgactcgggggcatgcat

SEQ ID NO: 1182 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacataattcacccctccactttgggaacgggaccaggctcactgtgacaggtatgggggctccactcttgactcgggggcatgcat

SEQ ID NO: 1183 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacataattcacccctccactttgggaacgggaccaggctcactgtgacaggtatgggggctccactcttgactcgggggcatgcat

SEQ ID NO: 1184 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacataattcacccctccactttgggaacgggaccaggctcactgtgacaggtatgggggctccactcttgactcgggggcatgcat

SEQ ID NO: 1185 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacataattcacccctccactttgggaacgggaccaggctcactgtgacaggtatgggggctccactcttgactcgggggcatgcat

SEQ ID NO: 1186 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacataattcacccctccactttgggaacgggaccaggctcactgtgacaggtatgggggctccactcttgactcgggggcatgcat

SEQ ID NO: 1187 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacataattcacccctccactttgggaacgggaccaggctcactgtgacaggtatgggggctccactcttgactcgggggcatgcat

SEQ ID NO: 1188 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacataattcacccctccactttgggaacgggaccaggctcactgtgacaggtatgggggctccactcttgactcgggggcatgcat

SEQ ID NO: 1189 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacataattcacccctccactttgggaacgggaccaggctcactgtgacaggtatgggggctccactcttgactcgggggcatgcat

SEQ ID NO: 1190 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacacaatgagcagttcttcgggccagggacacggctcaccgtgctaggtaagaagggggctccaggtgggagagaggggcatgcat

SEQ ID NO: 1191 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacacaatgagcagttcttcgggccagggacacggctcaccgtgctaggtaagaagggggctccaggtgggagagaggggcatgcat

SEQ ID NO: 1192 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacacaatgagcagttcttcgggccagggacacggctcaccgtgctaggtaagaagggggctccaggtgggagagaggggcatgcat

SEQ ID NO: 1193 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacacaatgagcagttcttcgggccagggacacggctcaccgtgctaggtaagaagggggctccaggtgggagagaggggcatgcat

SEQ ID NO: 1194 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacacaatgagcagttcttcgggccagggacacggctcaccgtgctaggtaagaagggggctccaggtgggagagaggggcatgcat

SEQ ID NO: 1195 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacacaatgagcagttcttcgggccagggacacggctcaccgtgctaggtaagaagggggctccaggtgggagagaggggcatgcat

SEQ ID NO: 1196 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacacaatgagcagttcttcgggccagggacacggctcaccgtgctaggtaagaagggggctccaggtgggagagaggggcatgcat

SEQ ID NO: 1197 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacacaatgagcagttcttcgggccagggacacggctcaccgtgctaggtaagaagggggctccaggtgggagagaggggcatgcat

SEQ ID NO: 1198 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacacaatgagcagttcttcgggccagggacacggctcaccgtgctaggtaagaagggggctccaggtgggagagaggggcatgcat

SEQ ID NO: 1199 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacacaatgagcagttcttcgggccagggacacggctcaccgtgctaggtaagaagggggctccaggtgggagagaggggcatgcat

SEQ ID NO: 1200 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacacaatgagcagttcttcgggccagggacacggctcaccgtgctaggtaagaagggggctccaggtgggagagaggggcatgcat

SEQ ID NO: 1201 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacacaatgagcagttcttcgggccagggacacggctcaccgtgctaggtaagaagggggctccaggtgggagagaggggcatgcat

SEQ ID NO: 1202 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacacaatgagcagttcttcgggccagggacacggctcaccgtgctaggtaagaagggggctccaggtgggagagaggggcatgcat

SEQ ID NO: 1203 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacacaatgagcagttcttcgggccagggacacggctcaccgtgctaggtaagaagggggctccaggtgggagagaggggcatgcat

SEQ ID NO: 1204 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacacaatgagcagttcttcgggccagggacacggctcaccgtgctaggtaagaagggggctccaggtgggagagaggggcatgcat

SEQ ID NO: 1205 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacacaatgagcagttcttcgggccagggacacggctcaccgtgctaggtaagaagggggctccaggtgggagagaggggcatgcat

SEQ ID NO: 1206 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacacaatgagcagttcttcgggccagggacacggctcaccgtgctaggtaagaagggggctccaggtgggagagaggggcatgcat

SEQ ID NO: 1207 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacacaatgagcagttcttcgggccagggacacggctcaccgtgctaggtaagaagggggctccaggtgggagagaggggcatgcat

SEQ ID NO: 1208 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacacaatgagcagttcttcgggccagggacacggctcaccgtgctaggtaagaagggggctccaggtgggagagaggggcatgcat

SEQ ID NO: 1209 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacacaatgagcagttcttcgggccagggacacggctcaccgtgctaggtaagaagggggctccaggtgggagagaggggcatgcat

SEQ ID NO: 1210 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacacaatgagcagttcttcgggccagggacacggctcaccgtgctaggtaagaagggggctccaggtgggagagaggggcatgcat

SEQ ID NO: 1211 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacacaatgagcagttcttcgggccagggacacggctcaccgtgctaggtaagaagggggctccaggtgggagagaggggcatgcat

SEQ ID NO: 1212 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacacaatgagcagttcttcgggccagggacacggctcaccgtgctaggtaagaagggggctccaggtgggagagaggggcatgcat

SEQ ID NO: 1213 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacacaatgagcagttcttcgggccagggacacggctcaccgtgctaggtaagaagggggctccaggtgggagagaggggcatgcat

SEQ ID NO: 1214 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacacaatgagcagttcttcgggccagggacacggctcaccgtgctaggtaagaagggggctccaggtgggagagaggggcatgcat

SEQ ID NO: 1215 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacacaatgagcagttcttcgggccagggacacggctcaccgtgctaggtaagaagggggctccaggtgggagagaggggcatgcat

SEQ ID NO: 1216 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacacaatgagcagttcttcgggccagggacacggctcaccgtgctaggtaagaagggggctccaggtgggagagaggggcatgcat

SEQ ID NO: 1217 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacacaatgagcagttcttcgggccagggacacggctcaccgtgctaggtaagaagggggctccaggtgggagagaggggcatgcat

SEQ ID NO: 1218 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacacaatgagcagttcttcgggccagggacacggctcaccgtgctaggtaagaagggggctccaggtgggagagaggggcatgcat

SEQ ID NO: 1219 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacacaatgagcagttcttcgggccagggacacggctcaccgtgctaggtaagaagggggctccaggtgggagagaggggcatgcat

SEQ ID NO: 1220 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacacaatgagcagttcttcgggccagggacacggctcaccgtgctaggtaagaagggggctccaggtgggagagaggggcatgcat

SEQ ID NO: 1221 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacacaatgagcagttcttcgggccagggacacggctcaccgtgctaggtaagaagggggctccaggtgggagagaggggcatgcat

SEQ ID NO: 1222 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacacaatgagcagttcttcgggccagggacacggctcaccgtgctaggtaagaagggggctccaggtgggagagaggggcatgcat

SEQ ID NO: 1223 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacacaatgagcagttcttcgggccagggacacggctcaccgtgctaggtaagaagggggctccaggtgggagagaggggcatgcat

SEQ ID NO: 1224 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacacaatgagcagttcttcgggccagggacacggctcaccgtgctaggtaagaagggggctccaggtgggagagaggggcatgcat

SEQ ID NO: 1225 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacacaatgagcagttcttcgggccagggacacggctcaccgtgctaggtaagaagggggctccaggtgggagagaggggcatgcat

SEQ ID NO: 1226 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacacaatgagcagttcttcgggccagggacacggctcaccgtgctaggtaagaagggggctccaggtgggagagaggggcatgcat

SEQ ID NO: 1227 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacacaatgagcagttcttcgggccagggacacggctcaccgtgctaggtaagaagggggctccaggtgggagagaggggcatgcat

SEQ ID NO: 1228 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacacaatgagcagttcttcgggccagggacacggctcaccgtgctaggtaagaagggggctccaggtgggagagaggggcatgcat

SEQ ID NO: 1229 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacacaatgagcagttcttcgggccagggacacggctcaccgtgctaggtaagaagggggctccaggtgggagagaggggcatgcat

SEQ ID NO: 1230 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacacaatgagcagttcttcgggccagggacacggctcaccgtgctaggtaagaagggggctccaggtgggagagaggggcatgcat

SEQ ID NO: 1231 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacacaatgagcagttcttcgggccagggacacggctcaccgtgctaggtaagaagggggctccaggtgggagagaggggcatgcat

SEQ ID NO: 1232 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacacaatgagcagttcttcgggccagggacacggctcaccgtgctaggtaagaagggggctccaggtgggagagaggggcatgcat

SEQ ID NO: 1233 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacacaatgagcagttcttcgggccagggacacggctcaccgtgctaggtaagaagggggctccaggtgggagagaggggcatgcat

SEQ ID NO: 1234 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacacaatgagcagttcttcgggccagggacacggctcaccgtgctaggtaagaagggggctccaggtgggagagaggggcatgcat

SEQ ID NO: 1235 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacacaatgagcagttcttcgggccagggacacggctcaccgtgctaggtaagaagggggctccaggtgggagagaggggcatgcat

SEQ ID NO: 1236 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacacaatgagcagttcttcgggccagggacacggctcaccgtgctaggtaagaagggggctccaggtgggagagaggggcatgcat

SEQ ID NO: 1237 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacacaatgagcagttcttcgggccagggacacggctcaccgtgctaggtaagaagggggctccaggtgggagagaggggcatgcat

SEQ ID NO: 1238 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacacaatgagcagttcttcgggccagggacacggctcaccgtgctaggtaagaagggggctccaggtgggagagaggggcatgcat

SEQ ID NO: 1239 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacacaatgagcagttcttcgggccagggacacggctcaccgtgctaggtaagaagggggctccaggtgggagagaggggcatgcat

SEQ ID NO: 1240 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacacaatgagcagttcttcgggccagggacacggctcaccgtgctaggtaagaagggggctccaggtgggagagaggggcatgcat

SEQ ID NO: 1241 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacacaatgagcagttcttcgggccagggacacggctcaccgtgctaggtaagaagggggctccaggtgggagagaggggcatgcat

SEQ ID NO: 1242 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacacaatgagcagttcttcgggccagggacacggctcaccgtgctaggtaagaagggggctccaggtgggagagaggggcatgcat

SEQ ID NO: 1243 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacaccggggagctgttttttggagaaggctctaggctgaccgtactgggtaaggaggcggttggggctccggagagctgcatgcat

SEQ ID NO: 1244 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacaccggggagctgttttttggagaaggctctaggctgaccgtactgggtaaggaggcggttggggctccggagagctgcatgcat

SEQ ID NO: 1245 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacaccggggagctgttttttggagaaggctctaggctgaccgtactgggtaaggaggcggttggggctccggagagctgcatgcat

SEQ ID NO: 1246 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacaccggggagctgttttttggagaaggctctaggctgaccgtactgggtaaggaggcggttggggctccggagagctgcatgcat

SEQ ID NO: 1247 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacaccggggagctgttttttggagaaggctctaggctgaccgtactgggtaaggaggcggttggggctccggagagctgcatgcat

SEQ ID NO: 1248 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacaccggggagctgttttttggagaaggctctaggctgaccgtactgggtaaggaggcggttggggctccggagagctgcatgcat

SEQ ID NO: 1249 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacaccggggagctgttttttggagaaggctctaggctgaccgtactgggtaaggaggcggttggggctccggagagctgcatgcat

SEQ ID NO: 1250 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacaccggggagctgttttttggagaaggctctaggctgaccgtactgggtaaggaggcggttggggctccggagagctgcatgcat

SEQ ID NO: 1251 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacaccggggagctgttttttggagaaggctctaggctgaccgtactgggtaaggaggcggttggggctccggagagctgcatgcat

SEQ ID NO: 1252 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacaccggggagctgttttttggagaaggctctaggctgaccgtactgggtaaggaggcggttggggctccggagagctgcatgcat

SEQ ID NO: 1253 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacaccggggagctgttttttggagaaggctctaggctgaccgtactgggtaaggaggcggttggggctccggagagctgcatgcat

SEQ ID NO: 1254 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacaccggggagctgttttttggagaaggctctaggctgaccgtactgggtaaggaggcggttggggctccggagagctgcatgcat

SEQ ID NO: 1255 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacaccggggagctgttttttggagaaggctctaggctgaccgtactgggtaaggaggcggttggggctccggagagctgcatgcat

SEQ ID NO: 1256 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacaccggggagctgttttttggagaaggctctaggctgaccgtactgggtaaggaggcggttggggctccggagagctgcatgcat

SEQ ID NO: 1257 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacaccggggagctgttttttggagaaggctctaggctgaccgtactgggtaaggaggcggttggggctccggagagctgcatgcat

SEQ ID NO: 1258 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacaccggggagctgttttttggagaaggctctaggctgaccgtactgggtaaggaggcggttggggctccggagagctgcatgcat

SEQ ID NO: 1259 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacaccggggagctgttttttggagaaggctctaggctgaccgtactgggtaaggaggcggttggggctccggagagctgcatgcat

SEQ ID NO: 1260 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacaccggggagctgttttttggagaaggctctaggctgaccgtactgggtaaggaggcggttggggctccggagagctgcatgcat

SEQ ID NO: 1261 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacaccggggagctgttttttggagaaggctctaggctgaccgtactgggtaaggaggcggttggggctccggagagctgcatgcat

SEQ ID NO: 1262 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacaccggggagctgttttttggagaaggctctaggctgaccgtactgggtaaggaggcggttggggctccggagagctgcatgcat

SEQ ID NO: 1263 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacaccggggagctgttttttggagaaggctctaggctgaccgtactgggtaaggaggcggttggggctccggagagctgcatgcat

SEQ ID NO: 1264 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacaccggggagctgttttttggagaaggctctaggctgaccgtactgggtaaggaggcggttggggctccggagagctgcatgcat

SEQ ID NO: 1265 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacaccggggagctgttttttggagaaggctctaggctgaccgtactgggtaaggaggcggttggggctccggagagctgcatgcat

SEQ ID NO: 1266 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacaccggggagctgttttttggagaaggctctaggctgaccgtactgggtaaggaggcggttggggctccggagagctgcatgcat

SEQ ID NO: 1267 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacaccggggagctgttttttggagaaggctctaggctgaccgtactgggtaaggaggcggttggggctccggagagctgcatgcat

SEQ ID NO: 1268 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacaccggggagctgttttttggagaaggctctaggctgaccgtactgggtaaggaggcggttggggctccggagagctgcatgcat

SEQ ID NO: 1269 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacaccggggagctgttttttggagaaggctctaggctgaccgtactgggtaaggaggcggttggggctccggagagctgcatgcat

SEQ ID NO: 1270 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacaccggggagctgttttttggagaaggctctaggctgaccgtactgggtaaggaggcggttggggctccggagagctgcatgcat

SEQ ID NO: 1271 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacaccggggagctgttttttggagaaggctctaggctgaccgtactgggtaaggaggcggttggggctccggagagctgcatgcat

SEQ ID NO: 1272 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacaccggggagctgttttttggagaaggctctaggctgaccgtactgggtaaggaggcggttggggctccggagagctgcatgcat

SEQ ID NO: 1273 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacaccggggagctgttttttggagaaggctctaggctgaccgtactgggtaaggaggcggttggggctccggagagctgcatgcat

SEQ ID NO: 1274 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacaccggggagctgttttttggagaaggctctaggctgaccgtactgggtaaggaggcggttggggctccggagagctgcatgcat

SEQ ID NO: 1275 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacaccggggagctgttttttggagaaggctctaggctgaccgtactgggtaaggaggcggttggggctccggagagctgcatgcat

SEQ ID NO: 1276 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacaccggggagctgttttttggagaaggctctaggctgaccgtactgggtaaggaggcggttggggctccggagagctgcatgcat

SEQ ID NO: 1277 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacaccggggagctgttttttggagaaggctctaggctgaccgtactgggtaaggaggcggttggggctccggagagctgcatgcat

SEQ ID NO: 1278 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacaccggggagctgttttttggagaaggctctaggctgaccgtactgggtaaggaggcggttggggctccggagagctgcatgcat

SEQ ID NO: 1279 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacaccggggagctgttttttggagaaggctctaggctgaccgtactgggtaaggaggcggttggggctccggagagctgcatgcat

SEQ ID NO: 1280 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacaccggggagctgttttttggagaaggctctaggctgaccgtactgggtaaggaggcggttggggctccggagagctgcatgcat

SEQ ID NO: 1281 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacaccggggagctgttttttggagaaggctctaggctgaccgtactgggtaaggaggcggttggggctccggagagctgcatgcat

SEQ ID NO: 1282 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacaccggggagctgttttttggagaaggctctaggctgaccgtactgggtaaggaggcggttggggctccggagagctgcatgcat

SEQ ID NO: 1283 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacaccggggagctgttttttggagaaggctctaggctgaccgtactgggtaaggaggcggttggggctccggagagctgcatgcat

SEQ ID NO: 1284 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacaccggggagctgttttttggagaaggctctaggctgaccgtactgggtaaggaggcggttggggctccggagagctgcatgcat

SEQ ID NO: 1285 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacaccggggagctgttttttggagaaggctctaggctgaccgtactgggtaaggaggcggttggggctccggagagctgcatgcat

SEQ ID NO: 1286 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacaccggggagctgttttttggagaaggctctaggctgaccgtactgggtaaggaggcggttggggctccggagagctgcatgcat

SEQ ID NO: 1287 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacaccggggagctgttttttggagaaggctctaggctgaccgtactgggtaaggaggcggttggggctccggagagctgcatgcat

SEQ ID NO: 1288 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacaccggggagctgttttttggagaaggctctaggctgaccgtactgggtaaggaggcggttggggctccggagagctgcatgcat

SEQ ID NO: 1289 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacaccggggagctgttttttggagaaggctctaggctgaccgtactgggtaaggaggcggttggggctccggagagctgcatgcat

SEQ ID NO: 1290 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacaccggggagctgttttttggagaaggctctaggctgaccgtactgggtaaggaggcggttggggctccggagagctgcatgcat

SEQ ID NO: 1291 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacaccggggagctgttttttggagaaggctctaggctgaccgtactgggtaaggaggcggttggggctccggagagctgcatgcat

SEQ ID NO: 1292 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacaccggggagctgttttttggagaaggctctaggctgaccgtactgggtaaggaggcggttggggctccggagagctgcatgcat

SEQ ID NO: 1293 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacaccggggagctgttttttggagaaggctctaggctgaccgtactgggtaaggaggcggttggggctccggagagctgcatgcat

SEQ ID NO: 1294 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacaccggggagctgttttttggagaaggctctaggctgaccgtactgggtaaggaggcggttggggctccggagagctgcatgcat

SEQ ID NO: 1295 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacaccggggagctgttttttggagaaggctctaggctgaccgtactgggtaaggaggcggttggggctccggagagctgcatgcat

SEQ ID NO: 1296 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacagatacgcagtattttggcccaggcacccggctgacagtgctcggtaagcgggggctcccgctgaagccccggaacgcatgcat

SEQ ID NO: 1297 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacagatacgcagtattttggcccaggcacccggctgacagtgctcggtaagcgggggctcccgctgaagccccggaacgcatgcat

SEQ ID NO: 1298 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacagatacgcagtattttggcccaggcacccggctgacagtgctcggtaagcgggggctcccgctgaagccccggaacgcatgcat

SEQ ID NO: 1299 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacagatacgcagtattttggcccaggcacccggctgacagtgctcggtaagcgggggctcccgctgaagccccggaacgcatgcat

SEQ ID NO: 1300 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacagatacgcagtattttggcccaggcacccggctgacagtgctcggtaagcgggggctcccgctgaagccccggaacgcatgcat

SEQ ID NO: 1301 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacagatacgcagtattttggcccaggcacccggctgacagtgctcggtaagcgggggctcccgctgaagccccggaacgcatgcat

SEQ ID NO: 1302 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacagatacgcagtattttggcccaggcacccggctgacagtgctcggtaagcgggggctcccgctgaagccccggaacgcatgcat

SEQ ID NO: 1303 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacagatacgcagtattttggcccaggcacccggctgacagtgctcggtaagcgggggctcccgctgaagccccggaacgcatgcat

SEQ ID NO: 1304 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacagatacgcagtattttggcccaggcacccggctgacagtgctcggtaagcgggggctcccgctgaagccccggaacgcatgcat

SEQ ID NO: 1305 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacagatacgcagtattttggcccaggcacccggctgacagtgctcggtaagcgggggctcccgctgaagccccggaacgcatgcat

SEQ ID NO: 1306 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacagatacgcagtattttggcccaggcacccggctgacagtgctcggtaagcgggggctcccgctgaagccccggaacgcatgcat

SEQ ID NO: 1307 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacagatacgcagtattttggcccaggcacccggctgacagtgctcggtaagcgggggctcccgctgaagccccggaacgcatgcat

SEQ ID NO: 1308 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacagatacgcagtattttggcccaggcacccggctgacagtgctcggtaagcgggggctcccgctgaagccccggaacgcatgcat

SEQ ID NO: 1309 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacagatacgcagtattttggcccaggcacccggctgacagtgctcggtaagcgggggctcccgctgaagccccggaacgcatgcat

SEQ ID NO: 1310 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacagatacgcagtattttggcccaggcacccggctgacagtgctcggtaagcgggggctcccgctgaagccccggaacgcatgcat

SEQ ID NO: 1311 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacagatacgcagtattttggcccaggcacccggctgacagtgctcggtaagcgggggctcccgctgaagccccggaacgcatgcat

SEQ ID NO: 1312 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacagatacgcagtattttggcccaggcacccggctgacagtgctcggtaagcgggggctcccgctgaagccccggaacgcatgcat

SEQ ID NO: 1313 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacagatacgcagtattttggcccaggcacccggctgacagtgctcggtaagcgggggctcccgctgaagccccggaacgcatgcat

SEQ ID NO: 1314 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacagatacgcagtattttggcccaggcacccggctgacagtgctcggtaagcgggggctcccgctgaagccccggaacgcatgcat

SEQ ID NO: 1315 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacagatacgcagtattttggcccaggcacccggctgacagtgctcggtaagcgggggctcccgctgaagccccggaacgcatgcat

SEQ ID NO: 1316 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacagatacgcagtattttggcccaggcacccggctgacagtgctcggtaagcgggggctcccgctgaagccccggaacgcatgcat

SEQ ID NO: 1317 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacagatacgcagtattttggcccaggcacccggctgacagtgctcggtaagcgggggctcccgctgaagccccggaacgcatgcat

SEQ ID NO: 1318 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacagatacgcagtattttggcccaggcacccggctgacagtgctcggtaagcgggggctcccgctgaagccccggaacgcatgcat

SEQ ID NO: 1319 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacagatacgcagtattttggcccaggcacccggctgacagtgctcggtaagcgggggctcccgctgaagccccggaacgcatgcat

SEQ ID NO: 1320 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacagatacgcagtattttggcccaggcacccggctgacagtgctcggtaagcgggggctcccgctgaagccccggaacgcatgcat

SEQ ID NO: 1321 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacagatacgcagtattttggcccaggcacccggctgacagtgctcggtaagcgggggctcccgctgaagccccggaacgcatgcat

SEQ ID NO: 1322 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacagatacgcagtattttggcccaggcacccggctgacagtgctcggtaagcgggggctcccgctgaagccccggaacgcatgcat

SEQ ID NO: 1323 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacagatacgcagtattttggcccaggcacccggctgacagtgctcggtaagcgggggctcccgctgaagccccggaacgcatgcat

SEQ ID NO: 1324 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacagatacgcagtattttggcccaggcacccggctgacagtgctcggtaagcgggggctcccgctgaagccccggaacgcatgcat

SEQ ID NO: 1325 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacagatacgcagtattttggcccaggcacccggctgacagtgctcggtaagcgggggctcccgctgaagccccggaacgcatgcat

SEQ ID NO: 1326 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacagatacgcagtattttggcccaggcacccggctgacagtgctcggtaagcgggggctcccgctgaagccccggaacgcatgcat

SEQ ID NO: 1327 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacagatacgcagtattttggcccaggcacccggctgacagtgctcggtaagcgggggctcccgctgaagccccggaacgcatgcat

SEQ ID NO: 1328 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacagatacgcagtattttggcccaggcacccggctgacagtgctcggtaagcgggggctcccgctgaagccccggaacgcatgcat

SEQ ID NO: 1329 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacagatacgcagtattttggcccaggcacccggctgacagtgctcggtaagcgggggctcccgctgaagccccggaacgcatgcat

SEQ ID NO: 1330 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacagatacgcagtattttggcccaggcacccggctgacagtgctcggtaagcgggggctcccgctgaagccccggaacgcatgcat

SEQ ID NO: 1331 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacagatacgcagtattttggcccaggcacccggctgacagtgctcggtaagcgggggctcccgctgaagccccggaacgcatgcat

SEQ ID NO: 1332 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacagatacgcagtattttggcccaggcacccggctgacagtgctcggtaagcgggggctcccgctgaagccccggaacgcatgcat

SEQ ID NO: 1333 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacagatacgcagtattttggcccaggcacccggctgacagtgctcggtaagcgggggctcccgctgaagccccggaacgcatgcat

SEQ ID NO: 1334 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacagatacgcagtattttggcccaggcacccggctgacagtgctcggtaagcgggggctcccgctgaagccccggaacgcatgcat

SEQ ID NO: 1335 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacagatacgcagtattttggcccaggcacccggctgacagtgctcggtaagcgggggctcccgctgaagccccggaacgcatgcat

SEQ ID NO: 1336 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacagatacgcagtattttggcccaggcacccggctgacagtgctcggtaagcgggggctcccgctgaagccccggaacgcatgcat

SEQ ID NO: 1337 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacagatacgcagtattttggcccaggcacccggctgacagtgctcggtaagcgggggctcccgctgaagccccggaacgcatgcat

SEQ ID NO: 1338 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacagatacgcagtattttggcccaggcacccggctgacagtgctcggtaagcgggggctcccgctgaagccccggaacgcatgcat

SEQ ID NO: 1339 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacagatacgcagtattttggcccaggcacccggctgacagtgctcggtaagcgggggctcccgctgaagccccggaacgcatgcat

SEQ ID NO: 1340 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacagatacgcagtattttggcccaggcacccggctgacagtgctcggtaagcgggggctcccgctgaagccccggaacgcatgcat

SEQ ID NO: 1341 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacagatacgcagtattttggcccaggcacccggctgacagtgctcggtaagcgggggctcccgctgaagccccggaacgcatgcat

SEQ ID NO: 1342 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacagatacgcagtattttggcccaggcacccggctgacagtgctcggtaagcgggggctcccgctgaagccccggaacgcatgcat

SEQ ID NO: 1343 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacagatacgcagtattttggcccaggcacccggctgacagtgctcggtaagcgggggctcccgctgaagccccggaacgcatgcat

SEQ ID NO: 1344 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacagatacgcagtattttggcccaggcacccggctgacagtgctcggtaagcgggggctcccgctgaagccccggaacgcatgcat

SEQ ID NO: 1345 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacagatacgcagtattttggcccaggcacccggctgacagtgctcggtaagcgggggctcccgctgaagccccggaacgcatgcat

SEQ ID NO: 1346 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacagatacgcagtattttggcccaggcacccggctgacagtgctcggtaagcgggggctcccgctgaagccccggaacgcatgcat

SEQ ID NO: 1347 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacagatacgcagtattttggcccaggcacccggctgacagtgctcggtaagcgggggctcccgctgaagccccggaacgcatgcat

SEQ ID NO: 1348 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacagatacgcagtattttggcccaggcacccggctgacagtgctcggtaagcgggggctcccgctgaagccccggaacgcatgcat

SEQ ID NO: 1349 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacaaaacattcagtacttcggcgccgggacccggctctcagtgctgggtaagctggggccgccgggggaccggggacggcatgcat

SEQ ID NO: 1350 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacaaaacattcagtacttcggcgccgggacccggctctcagtgctgggtaagctggggccgccgggggaccggggacggcatgcat

SEQ ID NO: 1351 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacaaaacattcagtacttcggcgccgggacccggctctcagtgctgggtaagctggggccgccgggggaccggggacggcatgcat

SEQ ID NO: 1352 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacaaaacattcagtacttcggcgccgggacccggctctcagtgctgggtaagctggggccgccgggggaccggggacggcatgcat

SEQ ID NO: 1353 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacaaaacattcagtacttcggcgccgggacccggctctcagtgctgggtaagctggggccgccgggggaccggggacggcatgcat

SEQ ID NO: 1354 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacaaaacattcagtacttcggcgccgggacccggctctcagtgctgggtaagctggggccgccgggggaccggggacggcatgcat

SEQ ID NO: 1355 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacaaaacattcagtacttcggcgccgggacccggctctcagtgctgggtaagctggggccgccgggggaccggggacggcatgcat

SEQ ID NO: 1356 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacaaaacattcagtacttcggcgccgggacccggctctcagtgctgggtaagctggggccgccgggggaccggggacggcatgcat

SEQ ID NO: 1357 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacaaaacattcagtacttcggcgccgggacccggctctcagtgctgggtaagctggggccgccgggggaccggggacggcatgcat

SEQ ID NO: 1358 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacaaaacattcagtacttcggcgccgggacccggctctcagtgctgggtaagctggggccgccgggggaccggggacggcatgcat

SEQ ID NO: 1359 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacaaaacattcagtacttcggcgccgggacccggctctcagtgctgggtaagctggggccgccgggggaccggggacggcatgcat

SEQ ID NO: 1360 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacaaaacattcagtacttcggcgccgggacccggctctcagtgctgggtaagctggggccgccgggggaccggggacggcatgcat

SEQ ID NO: 1361 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacaaaacattcagtacttcggcgccgggacccggctctcagtgctgggtaagctggggccgccgggggaccggggacggcatgcat

SEQ ID NO: 1362 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacaaaacattcagtacttcggcgccgggacccggctctcagtgctgggtaagctggggccgccgggggaccggggacggcatgcat

SEQ ID NO: 1363 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacaaaacattcagtacttcggcgccgggacccggctctcagtgctgggtaagctggggccgccgggggaccggggacggcatgcat

SEQ ID NO: 1364 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacaaaacattcagtacttcggcgccgggacccggctctcagtgctgggtaagctggggccgccgggggaccggggacggcatgcat

SEQ ID NO: 1365 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacaaaacattcagtacttcggcgccgggacccggctctcagtgctgggtaagctggggccgccgggggaccggggacggcatgcat

SEQ ID NO: 1366 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacaaaacattcagtacttcggcgccgggacccggctctcagtgctgggtaagctggggccgccgggggaccggggacggcatgcat

SEQ ID NO: 1367 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacaaaacattcagtacttcggcgccgggacccggctctcagtgctgggtaagctggggccgccgggggaccggggacggcatgcat

SEQ ID NO: 1368 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacaaaacattcagtacttcggcgccgggacccggctctcagtgctgggtaagctggggccgccgggggaccggggacggcatgcat

SEQ ID NO: 1369 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacaaaacattcagtacttcggcgccgggacccggctctcagtgctgggtaagctggggccgccgggggaccggggacggcatgcat

SEQ ID NO: 1370 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacaaaacattcagtacttcggcgccgggacccggctctcagtgctgggtaagctggggccgccgggggaccggggacggcatgcat

SEQ ID NO: 1371 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacaaaacattcagtacttcggcgccgggacccggctctcagtgctgggtaagctggggccgccgggggaccggggacggcatgcat

SEQ ID NO: 1372 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacaaaacattcagtacttcggcgccgggacccggctctcagtgctgggtaagctggggccgccgggggaccggggacggcatgcat

SEQ ID NO: 1373 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacaaaacattcagtacttcggcgccgggacccggctctcagtgctgggtaagctggggccgccgggggaccggggacggcatgcat

SEQ ID NO: 1374 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacaaaacattcagtacttcggcgccgggacccggctctcagtgctgggtaagctggggccgccgggggaccggggacggcatgcat

SEQ ID NO: 1375 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacaaaacattcagtacttcggcgccgggacccggctctcagtgctgggtaagctggggccgccgggggaccggggacggcatgcat

SEQ ID NO: 1376 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacaaaacattcagtacttcggcgccgggacccggctctcagtgctgggtaagctggggccgccgggggaccggggacggcatgcat

SEQ ID NO: 1377 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacaaaacattcagtacttcggcgccgggacccggctctcagtgctgggtaagctggggccgccgggggaccggggacggcatgcat

SEQ ID NO: 1378 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacaaaacattcagtacttcggcgccgggacccggctctcagtgctgggtaagctggggccgccgggggaccggggacggcatgcat

SEQ ID NO: 1379 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacaaaacattcagtacttcggcgccgggacccggctctcagtgctgggtaagctggggccgccgggggaccggggacggcatgcat

SEQ ID NO: 1380 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacaaaacattcagtacttcggcgccgggacccggctctcagtgctgggtaagctggggccgccgggggaccggggacggcatgcat

SEQ ID NO: 1381 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacaaaacattcagtacttcggcgccgggacccggctctcagtgctgggtaagctggggccgccgggggaccggggacggcatgcat

SEQ ID NO: 1382 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacaaaacattcagtacttcggcgccgggacccggctctcagtgctgggtaagctggggccgccgggggaccggggacggcatgcat

SEQ ID NO: 1383 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacaaaacattcagtacttcggcgccgggacccggctctcagtgctgggtaagctggggccgccgggggaccggggacggcatgcat

SEQ ID NO: 1384 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacaaaacattcagtacttcggcgccgggacccggctctcagtgctgggtaagctggggccgccgggggaccggggacggcatgcat

SEQ ID NO: 1385 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacaaaacattcagtacttcggcgccgggacccggctctcagtgctgggtaagctggggccgccgggggaccggggacggcatgcat

SEQ ID NO: 1386 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacaaaacattcagtacttcggcgccgggacccggctctcagtgctgggtaagctggggccgccgggggaccggggacggcatgcat

SEQ ID NO: 1387 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacaaaacattcagtacttcggcgccgggacccggctctcagtgctgggtaagctggggccgccgggggaccggggacggcatgcat

SEQ ID NO: 1388 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacaaaacattcagtacttcggcgccgggacccggctctcagtgctgggtaagctggggccgccgggggaccggggacggcatgcat

SEQ ID NO: 1389 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacaaaacattcagtacttcggcgccgggacccggctctcagtgctgggtaagctggggccgccgggggaccggggacggcatgcat

SEQ ID NO: 1390 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacaaaacattcagtacttcggcgccgggacccggctctcagtgctgggtaagctggggccgccgggggaccggggacggcatgcat

SEQ ID NO: 1391 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacaaaacattcagtacttcggcgccgggacccggctctcagtgctgggtaagctggggccgccgggggaccggggacggcatgcat

SEQ ID NO: 1392 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacaaaacattcagtacttcggcgccgggacccggctctcagtgctgggtaagctggggccgccgggggaccggggacggcatgcat

SEQ ID NO: 1393 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacaaaacattcagtacttcggcgccgggacccggctctcagtgctgggtaagctggggccgccgggggaccggggacggcatgcat

SEQ ID NO: 1394 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacaaaacattcagtacttcggcgccgggacccggctctcagtgctgggtaagctggggccgccgggggaccggggacggcatgcat

SEQ ID NO: 1395 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacaaaacattcagtacttcggcgccgggacccggctctcagtgctgggtaagctggggccgccgggggaccggggacggcatgcat

SEQ ID NO: 1396 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacaaaacattcagtacttcggcgccgggacccggctctcagtgctgggtaagctggggccgccgggggaccggggacggcatgcat

SEQ ID NO: 1397 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacaaaacattcagtacttcggcgccgggacccggctctcagtgctgggtaagctggggccgccgggggaccggggacggcatgcat

SEQ ID NO: 1398 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacaaaacattcagtacttcggcgccgggacccggctctcagtgctgggtaagctggggccgccgggggaccggggacggcatgcat

SEQ ID NO: 1399 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacaaaacattcagtacttcggcgccgggacccggctctcagtgctgggtaagctggggccgccgggggaccggggacggcatgcat

SEQ ID NO: 1400 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacaaaacattcagtacttcggcgccgggacccggctctcagtgctgggtaagctggggccgccgggggaccggggacggcatgcat

SEQ ID NO: 1401 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacaaaacattcagtacttcggcgccgggacccggctctcagtgctgggtaagctggggccgccgggggaccggggacggcatgcat

SEQ ID NO: 1402 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacgagacccagtacttcgggccaggcacgcggctcctggtgctcggtgagcgcgggctgctggggcgcgggcgcgggcgcatgcat

SEQ ID NO: 1403 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacgagacccagtacttcgggccaggcacgcggctcctggtgctcggtgagcgcgggctgctggggcgcgggcgcgggcgcatgcat

SEQ ID NO: 1404 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacgagacccagtacttcgggccaggcacgcggctcctggtgctcggtgagcgcgggctgctggggcgcgggcgcgggcgcatgcat

SEQ ID NO: 1405 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacgagacccagtacttcgggccaggcacgcggctcctggtgctcggtgagcgcgggctgctggggcgcgggcgcgggcgcatgcat

SEQ ID NO: 1406 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacgagacccagtacttcgggccaggcacgcggctcctggtgctcggtgagcgcgggctgctggggcgcgggcgcgggcgcatgcat

SEQ ID NO: 1407 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacgagacccagtacttcgggccaggcacgcggctcctggtgctcggtgagcgcgggctgctggggcgcgggcgcgggcgcatgcat

SEQ ID NO: 1408 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacgagacccagtacttcgggccaggcacgcggctcctggtgctcggtgagcgcgggctgctggggcgcgggcgcgggcgcatgcat

SEQ ID NO: 1409 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacgagacccagtacttcgggccaggcacgcggctcctggtgctcggtgagcgcgggctgctggggcgcgggcgcgggcgcatgcat

SEQ ID NO: 1410 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacgagacccagtacttcgggccaggcacgcggctcctggtgctcggtgagcgcgggctgctggggcgcgggcgcgggcgcatgcat

SEQ ID NO: 1411 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacgagacccagtacttcgggccaggcacgcggctcctggtgctcggtgagcgcgggctgctggggcgcgggcgcgggcgcatgcat

SEQ ID NO: 1412 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacgagacccagtacttcgggccaggcacgcggctcctggtgctcggtgagcgcgggctgctggggcgcgggcgcgggcgcatgcat

SEQ ID NO: 1413 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacgagacccagtacttcgggccaggcacgcggctcctggtgctcggtgagcgcgggctgctggggcgcgggcgcgggcgcatgcat

SEQ ID NO: 1414 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacgagacccagtacttcgggccaggcacgcggctcctggtgctcggtgagcgcgggctgctggggcgcgggcgcgggcgcatgcat

SEQ ID NO: 1415 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacgagacccagtacttcgggccaggcacgcggctcctggtgctcggtgagcgcgggctgctggggcgcgggcgcgggcgcatgcat

SEQ ID NO: 1416 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacgagacccagtacttcgggccaggcacgcggctcctggtgctcggtgagcgcgggctgctggggcgcgggcgcgggcgcatgcat

SEQ ID NO: 1417 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacgagacccagtacttcgggccaggcacgcggctcctggtgctcggtgagcgcgggctgctggggcgcgggcgcgggcgcatgcat

SEQ ID NO: 1418 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacgagacccagtacttcgggccaggcacgcggctcctggtgctcggtgagcgcgggctgctggggcgcgggcgcgggcgcatgcat

SEQ ID NO: 1419 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacgagacccagtacttcgggccaggcacgcggctcctggtgctcggtgagcgcgggctgctggggcgcgggcgcgggcgcatgcat

SEQ ID NO: 1420 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacgagacccagtacttcgggccaggcacgcggctcctggtgctcggtgagcgcgggctgctggggcgcgggcgcgggcgcatgcat

SEQ ID NO: 1421 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacgagacccagtacttcgggccaggcacgcggctcctggtgctcggtgagcgcgggctgctggggcgcgggcgcgggcgcatgcat

SEQ ID NO: 1422 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacgagacccagtacttcgggccaggcacgcggctcctggtgctcggtgagcgcgggctgctggggcgcgggcgcgggcgcatgcat

SEQ ID NO: 1423 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacgagacccagtacttcgggccaggcacgcggctcctggtgctcggtgagcgcgggctgctggggcgcgggcgcgggcgcatgcat

SEQ ID NO: 1424 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacgagacccagtacttcgggccaggcacgcggctcctggtgctcggtgagcgcgggctgctggggcgcgggcgcgggcgcatgcat

SEQ ID NO: 1425 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacgagacccagtacttcgggccaggcacgcggctcctggtgctcggtgagcgcgggctgctggggcgcgggcgcgggcgcatgcat

SEQ ID NO: 1426 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacgagacccagtacttcgggccaggcacgcggctcctggtgctcggtgagcgcgggctgctggggcgcgggcgcgggcgcatgcat

SEQ ID NO: 1427 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacgagacccagtacttcgggccaggcacgcggctcctggtgctcggtgagcgcgggctgctggggcgcgggcgcgggcgcatgcat

SEQ ID NO: 1428 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacgagacccagtacttcgggccaggcacgcggctcctggtgctcggtgagcgcgggctgctggggcgcgggcgcgggcgcatgcat

SEQ ID NO: 1429 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacgagacccagtacttcgggccaggcacgcggctcctggtgctcggtgagcgcgggctgctggggcgcgggcgcgggcgcatgcat

SEQ ID NO: 1430 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacgagacccagtacttcgggccaggcacgcggctcctggtgctcggtgagcgcgggctgctggggcgcgggcgcgggcgcatgcat

SEQ ID NO: 1431 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacgagacccagtacttcgggccaggcacgcggctcctggtgctcggtgagcgcgggctgctggggcgcgggcgcgggcgcatgcat

SEQ ID NO: 1432 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacgagacccagtacttcgggccaggcacgcggctcctggtgctcggtgagcgcgggctgctggggcgcgggcgcgggcgcatgcat

SEQ ID NO: 1433 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacgagacccagtacttcgggccaggcacgcggctcctggtgctcggtgagcgcgggctgctggggcgcgggcgcgggcgcatgcat

SEQ ID NO: 1434 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacgagacccagtacttcgggccaggcacgcggctcctggtgctcggtgagcgcgggctgctggggcgcgggcgcgggcgcatgcat

SEQ ID NO: 1435 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacgagacccagtacttcgggccaggcacgcggctcctggtgctcggtgagcgcgggctgctggggcgcgggcgcgggcgcatgcat

SEQ ID NO: 1436 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacgagacccagtacttcgggccaggcacgcggctcctggtgctcggtgagcgcgggctgctggggcgcgggcgcgggcgcatgcat

SEQ ID NO: 1437 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacgagacccagtacttcgggccaggcacgcggctcctggtgctcggtgagcgcgggctgctggggcgcgggcgcgggcgcatgcat

SEQ ID NO: 1438 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacgagacccagtacttcgggccaggcacgcggctcctggtgctcggtgagcgcgggctgctggggcgcgggcgcgggcgcatgcat

SEQ ID NO: 1439 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacgagacccagtacttcgggccaggcacgcggctcctggtgctcggtgagcgcgggctgctggggcgcgggcgcgggcgcatgcat

SEQ ID NO: 1440 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacgagacccagtacttcgggccaggcacgcggctcctggtgctcggtgagcgcgggctgctggggcgcgggcgcgggcgcatgcat

SEQ ID NO: 1441 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacgagacccagtacttcgggccaggcacgcggctcctggtgctcggtgagcgcgggctgctggggcgcgggcgcgggcgcatgcat

SEQ ID NO: 1442 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacgagacccagtacttcgggccaggcacgcggctcctggtgctcggtgagcgcgggctgctggggcgcgggcgcgggcgcatgcat

SEQ ID NO: 1443 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacgagacccagtacttcgggccaggcacgcggctcctggtgctcggtgagcgcgggctgctggggcgcgggcgcgggcgcatgcat

SEQ ID NO: 1444 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacgagacccagtacttcgggccaggcacgcggctcctggtgctcggtgagcgcgggctgctggggcgcgggcgcgggcgcatgcat

SEQ ID NO: 1445 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacgagacccagtacttcgggccaggcacgcggctcctggtgctcggtgagcgcgggctgctggggcgcgggcgcgggcgcatgcat

SEQ ID NO: 1446 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacgagacccagtacttcgggccaggcacgcggctcctggtgctcggtgagcgcgggctgctggggcgcgggcgcgggcgcatgcat

SEQ ID NO: 1447 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacgagacccagtacttcgggccaggcacgcggctcctggtgctcggtgagcgcgggctgctggggcgcgggcgcgggcgcatgcat

SEQ ID NO: 1448 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacgagacccagtacttcgggccaggcacgcggctcctggtgctcggtgagcgcgggctgctggggcgcgggcgcgggcgcatgcat

SEQ ID NO: 1449 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacgagacccagtacttcgggccaggcacgcggctcctggtgctcggtgagcgcgggctgctggggcgcgggcgcgggcgcatgcat

SEQ ID NO: 1450 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacgagacccagtacttcgggccaggcacgcggctcctggtgctcggtgagcgcgggctgctggggcgcgggcgcgggcgcatgcat

SEQ ID NO: 1451 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacgagacccagtacttcgggccaggcacgcggctcctggtgctcggtgagcgcgggctgctggggcgcgggcgcgggcgcatgcat

SEQ ID NO: 1452 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacgagacccagtacttcgggccaggcacgcggctcctggtgctcggtgagcgcgggctgctggggcgcgggcgcgggcgcatgcat

SEQ ID NO: 1453 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacgagacccagtacttcgggccaggcacgcggctcctggtgctcggtgagcgcgggctgctggggcgcgggcgcgggcgcatgcat

SEQ ID NO: 1454 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacgagacccagtacttcgggccaggcacgcggctcctggtgctcggtgagcgcgggctgctggggcgcgggcgcgggcgcatgcat

SEQ ID NO: 1455 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacgggccaacgtcctgactttcggggccggcagcaggctgaccgtgctgggtgagttttcgcgggaccacccgggcgggcatgcat

SEQ ID NO: 1456 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacgggccaacgtcctgactttcggggccggcagcaggctgaccgtgctgggtgagttttcgcgggaccacccgggcgggcatgcat

SEQ ID NO: 1457 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacgggccaacgtcctgactttcggggccggcagcaggctgaccgtgctgggtgagttttcgcgggaccacccgggcgggcatgcat

SEQ ID NO: 1458 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacgggccaacgtcctgactttcggggccggcagcaggctgaccgtgctgggtgagttttcgcgggaccacccgggcgggcatgcat

SEQ ID NO: 1459 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacgggccaacgtcctgactttcggggccggcagcaggctgaccgtgctgggtgagttttcgcgggaccacccgggcgggcatgcat

SEQ ID NO: 1460 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacgggccaacgtcctgactttcggggccggcagcaggctgaccgtgctgggtgagttttcgcgggaccacccgggcgggcatgcat

SEQ ID NO: 1461 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacgggccaacgtcctgactttcggggccggcagcaggctgaccgtgctgggtgagttttcgcgggaccacccgggcgggcatgcat

SEQ ID NO: 1462 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacgggccaacgtcctgactttcggggccggcagcaggctgaccgtgctgggtgagttttcgcgggaccacccgggcgggcatgcat

SEQ ID NO: 1463 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacgggccaacgtcctgactttcggggccggcagcaggctgaccgtgctgggtgagttttcgcgggaccacccgggcgggcatgcat

SEQ ID NO: 1464 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacgggccaacgtcctgactttcggggccggcagcaggctgaccgtgctgggtgagttttcgcgggaccacccgggcgggcatgcat

SEQ ID NO: 1465 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacgggccaacgtcctgactttcggggccggcagcaggctgaccgtgctgggtgagttttcgcgggaccacccgggcgggcatgcat

SEQ ID NO: 1466 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacgggccaacgtcctgactttcggggccggcagcaggctgaccgtgctgggtgagttttcgcgggaccacccgggcgggcatgcat

SEQ ID NO: 1467 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacgggccaacgtcctgactttcggggccggcagcaggctgaccgtgctgggtgagttttcgcgggaccacccgggcgggcatgcat

SEQ ID NO: 1468 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacgggccaacgtcctgactttcggggccggcagcaggctgaccgtgctgggtgagttttcgcgggaccacccgggcgggcatgcat

SEQ ID NO: 1469 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacgggccaacgtcctgactttcggggccggcagcaggctgaccgtgctgggtgagttttcgcgggaccacccgggcgggcatgcat

SEQ ID NO: 1470 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacgggccaacgtcctgactttcggggccggcagcaggctgaccgtgctgggtgagttttcgcgggaccacccgggcgggcatgcat

SEQ ID NO: 1471 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacgggccaacgtcctgactttcggggccggcagcaggctgaccgtgctgggtgagttttcgcgggaccacccgggcgggcatgcat

SEQ ID NO: 1472 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacgggccaacgtcctgactttcggggccggcagcaggctgaccgtgctgggtgagttttcgcgggaccacccgggcgggcatgcat

SEQ ID NO: 1473 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacgggccaacgtcctgactttcggggccggcagcaggctgaccgtgctgggtgagttttcgcgggaccacccgggcgggcatgcat

SEQ ID NO: 1474 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacgggccaacgtcctgactttcggggccggcagcaggctgaccgtgctgggtgagttttcgcgggaccacccgggcgggcatgcat

SEQ ID NO: 1475 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacgggccaacgtcctgactttcggggccggcagcaggctgaccgtgctgggtgagttttcgcgggaccacccgggcgggcatgcat

SEQ ID NO: 1476 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacgggccaacgtcctgactttcggggccggcagcaggctgaccgtgctgggtgagttttcgcgggaccacccgggcgggcatgcat

SEQ ID NO: 1477 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacgggccaacgtcctgactttcggggccggcagcaggctgaccgtgctgggtgagttttcgcgggaccacccgggcgggcatgcat

SEQ ID NO: 1478 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacgggccaacgtcctgactttcggggccggcagcaggctgaccgtgctgggtgagttttcgcgggaccacccgggcgggcatgcat

SEQ ID NO: 1479 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacgggccaacgtcctgactttcggggccggcagcaggctgaccgtgctgggtgagttttcgcgggaccacccgggcgggcatgcat

SEQ ID NO: 1480 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacgggccaacgtcctgactttcggggccggcagcaggctgaccgtgctgggtgagttttcgcgggaccacccgggcgggcatgcat

SEQ ID NO: 1481 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacgggccaacgtcctgactttcggggccggcagcaggctgaccgtgctgggtgagttttcgcgggaccacccgggcgggcatgcat

SEQ ID NO: 1482 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacgggccaacgtcctgactttcggggccggcagcaggctgaccgtgctgggtgagttttcgcgggaccacccgggcgggcatgcat

SEQ ID NO: 1483 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacgggccaacgtcctgactttcggggccggcagcaggctgaccgtgctgggtgagttttcgcgggaccacccgggcgggcatgcat

SEQ ID NO: 1484 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacgggccaacgtcctgactttcggggccggcagcaggctgaccgtgctgggtgagttttcgcgggaccacccgggcgggcatgcat

SEQ ID NO: 1485 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacgggccaacgtcctgactttcggggccggcagcaggctgaccgtgctgggtgagttttcgcgggaccacccgggcgggcatgcat

SEQ ID NO: 1486 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacgggccaacgtcctgactttcggggccggcagcaggctgaccgtgctgggtgagttttcgcgggaccacccgggcgggcatgcat

SEQ ID NO: 1487 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacgggccaacgtcctgactttcggggccggcagcaggctgaccgtgctgggtgagttttcgcgggaccacccgggcgggcatgcat

SEQ ID NO: 1488 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacgggccaacgtcctgactttcggggccggcagcaggctgaccgtgctgggtgagttttcgcgggaccacccgggcgggcatgcat

SEQ ID NO: 1489 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacgggccaacgtcctgactttcggggccggcagcaggctgaccgtgctgggtgagttttcgcgggaccacccgggcgggcatgcat

SEQ ID NO: 1490 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacgggccaacgtcctgactttcggggccggcagcaggctgaccgtgctgggtgagttttcgcgggaccacccgggcgggcatgcat

SEQ ID NO: 1491 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacgggccaacgtcctgactttcggggccggcagcaggctgaccgtgctgggtgagttttcgcgggaccacccgggcgggcatgcat

SEQ ID NO: 1492 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacgggccaacgtcctgactttcggggccggcagcaggctgaccgtgctgggtgagttttcgcgggaccacccgggcgggcatgcat

SEQ ID NO: 1493 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacgggccaacgtcctgactttcggggccggcagcaggctgaccgtgctgggtgagttttcgcgggaccacccgggcgggcatgcat

SEQ ID NO: 1494 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacgggccaacgtcctgactttcggggccggcagcaggctgaccgtgctgggtgagttttcgcgggaccacccgggcgggcatgcat

SEQ ID NO: 1495 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacgggccaacgtcctgactttcggggccggcagcaggctgaccgtgctgggtgagttttcgcgggaccacccgggcgggcatgcat

SEQ ID NO: 1496 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacgggccaacgtcctgactttcggggccggcagcaggctgaccgtgctgggtgagttttcgcgggaccacccgggcgggcatgcat

SEQ ID NO: 1497 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacgggccaacgtcctgactttcggggccggcagcaggctgaccgtgctgggtgagttttcgcgggaccacccgggcgggcatgcat

SEQ ID NO: 1498 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacgggccaacgtcctgactttcggggccggcagcaggctgaccgtgctgggtgagttttcgcgggaccacccgggcgggcatgcat

SEQ ID NO: 1499 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacgggccaacgtcctgactttcggggccggcagcaggctgaccgtgctgggtgagttttcgcgggaccacccgggcgggcatgcat

SEQ ID NO: 1500 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacgggccaacgtcctgactttcggggccggcagcaggctgaccgtgctgggtgagttttcgcgggaccacccgggcgggcatgcat

SEQ ID NO: 1501 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacgggccaacgtcctgactttcggggccggcagcaggctgaccgtgctgggtgagttttcgcgggaccacccgggcgggcatgcat

SEQ ID NO: 1502 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacgggccaacgtcctgactttcggggccggcagcaggctgaccgtgctgggtgagttttcgcgggaccacccgggcgggcatgcat

SEQ ID NO: 1503 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacgggccaacgtcctgactttcggggccggcagcaggctgaccgtgctgggtgagttttcgcgggaccacccgggcgggcatgcat

SEQ ID NO: 1504 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacgggccaacgtcctgactttcggggccggcagcaggctgaccgtgctgggtgagttttcgcgggaccacccgggcgggcatgcat

SEQ ID NO: 1505 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacgggccaacgtcctgactttcggggccggcagcaggctgaccgtgctgggtgagttttcgcgggaccacccgggcgggcatgcat

SEQ ID NO: 1506 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacgggccaacgtcctgactttcggggccggcagcaggctgaccgtgctgggtgagttttcgcgggaccacccgggcgggcatgcat

SEQ ID NO: 1507 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacgggccaacgtcctgactttcggggccggcagcaggctgaccgtgctgggtgagttttcgcgggaccacccgggcgggcatgcat

SEQ ID NO: 1508 - DNA, 239 bp, Artificial Sequence
  Oligonucleotide
atgaattcttttataataatgaaatctcagagaagtctgaaatattcgatgatcaattctcagttgaaaggcctgatggatcaaatttcaatccggtccacaaagctggaggactcagccatgtacttctgtgccagcagtcaaggtcagtcgacacgagcagtacttcgggccgggcaccaggctcacggtcacaggtgagattcgggcgtctccccaccttccagccccgcatgcat

SEQ ID NO: 1509 - DNA, 239 bp, Artificial Sequence
  Oligonucleotide
atgaattcagctacaataataaggagctcattataaatgaaacagttccaaatcgcttctcacctaaatctccagacaaagctcacttaaatcaattccctggagcttggtgactctgctgtgtatttctgtgccagcagctacgtacggtcgacacgagcagtacttcgggccgggcaccaggctcacggtcacaggtgagattcgggcgtctccccaccttccagccccgcatgcat

SEQ ID NO: 1510 - DNA, 239 bp, Artificial Sequence
  Oligonucleotide
atgaattcgtctacagctatgagaaactctctataaatgaaagtgtgccaagtcgcttctcacctgaatgccccaacagctctctcttaactacacgccctgcagccagaagactcagccctgtatctctgcgccagcagctacgcgttgtcgacacgagcagtacttcgggccgggcaccaggctcacggtcacaggtgagattcgggcgtctccccaccttccagccccgcatgcat

SEQ ID NO: 1511 - DNA, 239 bp, Artificial Sequence
  Oligonucleotide
atgaattcgtctacaactttaaagaacagactgaaaacaacagtgtgccaagtcgcttctcacctgaatgccccaacagctctcacttatctacacaccctgcagccagaagactcggccctgtatctctgcgccagcagcctcagtgagtcgacacgagcagtacttcgggccgggcaccaggctcacggtcacaggtgagattcgggcgtctccccaccttccagccccgcatgcat

SEQ ID NO: 1512 - DNA, 239 bp, Artificial Sequence
  Oligonucleotide
atgaattcgtctacagtcttgaagaacgggttgaaaacaacagtgtgccaagtcgcttctcacctgaatgccccaacagctctcacttatctacacaccctgcagccagaagactcggccctgtatctctgcgccagcagcgtgtctacgtcgacacgagcagtacttcgggccgggcaccaggctcacggtcacaggtgagattcgggcgtctccccaccttccagccccgcatgcat

SEQ ID NO: 1513 - DNA, 239 bp, Artificial Sequence
  Oligonucleotide
atgaattctgaatacttcagtgagacacagagaaacaaaggaaacttccctggtcgattctcagggcgccagttctctaactctcgctcttgtgagcaccttggagctgggggactcggccctttatctttgcgccagcagagtaccgagtcgacacgagcagtacttcgggccgggcaccaggctcacggtcacaggtgagattcgggcgtctccccaccttccagccccgcatgcat

SEQ ID NO: 1514 - DNA, 239 bp, Artificial Sequence
  Oligonucleotide
atgaattctgaatatgctaatgagttaaggagatcagaaggaaacttccctaatcgattctcagggcgccagttccatgactgttgctcttgtgagtgccttggagctgggggactcggccctgtatctctgtgccagaagttgcctcagtcgacacgagcagtacttcgggccgggcaccaggctcacggtcacaggtgagattcgggcgtctccccaccttccagccccgcatgcat

SEQ ID NO: 1515 - DNA, 239 bp, Artificial Sequence
  Oligonucleotide
atgaattctcagtattatagggaggaagagaatggcagaggaaacttccctcctagattctcaggtctccagttccctaattatagctcttgtgaacgccttggagctggacgactcggccctgtatctctgtgccagcagtcgttagcgtcgacacgagcagtacttcgggccgggcaccaggctcacggtcacaggtgagattcgggcgtctccccaccttccagccccgcatgcat

SEQ ID NO: 1516 - DNA, 239 bp, Artificial Sequence
  Oligonucleotide
atgaattctcagtattatgagaaagaagagagaggaagaggaaacttccctgatcgattctcagctcgccagttccctaactatagctcttgtgaacgccttgttgctgggggactcggccctgtatctctgtgccagcagtggacatggtcgacacgagcagtacttcgggccgggcaccaggctcacggtcacaggtgagattcgggcgtctccccaccttccagccccgcatgcat

SEQ ID NO: 1517 - DNA, 239 bp, Artificial Sequence
  Oligonucleotide
atgaattctcagtattatgaggaggaagagagacagagaggcaacttccctgatcgattctcaggtcaccagttccctaactatagctcttgtgaacgccttgttgctgggggactcggccctctatctctgtgccagcagaggttgctgtcgacacgagcagtacttcgggccgggcaccaggctcacggtcacaggtgagattcgggcgtctccccaccttccagccccgcatgcat

SEQ ID NO: 1518 - DNA, 239 bp, Artificial Sequence
  Oligonucleotide
atgaattctcagtattatgagaaagaagagagaggaagaggaaacttccctgatcaattctcaggtcaccagttccctaactatagctcttgtgaacgccttgttgctaggggactcggccctctatctctgtgccagcaggtacagtggtcgacacgagcagtacttcgggccgggcaccaggctcacggtcacaggtgagattcgggcgtctccccaccttccagccccgcatgcat

SEQ ID NO: 1519 - DNA, 239 bp, Artificial Sequence
  Oligonucleotide
atgaattcttggtatgacgagggtgaagagagaaacagaggaaacttccctcctagattttcaggtcgccagttccctaattatagctcttgtgaacgccttggagctggaggactcggccctgtatctctgtgccagcagatccatgggtcgacacgagcagtacttcgggccgggcaccaggctcacggtcacaggtgagattcgggcgtctccccaccttccagccccgcatgcat

SEQ ID NO: 1520 - DNA, 239 bp, Artificial Sequence
  Oligonucleotide
atgaattctactcagcttctgagggtaccactgacaaaggagaagtccccaatggctacaatgtctccagattaaacaaacgggagttctctggagtcggctgctccctcccagacatctgtgtacttctgtgccagcagttgatgcgagtcgacacgagcagtacttcgggccgggcaccaggctcacggtcacaggtgagattcgggcgtctccccaccttccagccccgcatgcat

SEQ ID NO: 1521 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtgtagcagtgtcgacacgagcagtacttcgggccgggcaccaggctcacggtcacaggtgagattcgggcgtctccccaccttccagccccgcatgcat

SEQ ID NO: 1522 - DNA, 239 bp, Artificial Sequence
  Oligonucleotide
atgaattctactcagttggtgagggtacaactgccaaaggagaggtccctgatggctacaatgtctccagattaaaaaaacagaatttccttggagtcggctgctccctcccaaacatctgtgtacttctgtgccagcagtggatcatcgtcgacacgagcagtacttcgggccgggcaccaggctcacggtcacaggtgagattcgggcgtctccccaccttccagccccgcatgcat

SEQ ID NO: 1523 - DNA, 239 bp, Artificial Sequence
  Oligonucleotide
atgaattctattcaaatactgcaggtaccactggcaaaggagaagtccctgatggttatagtgtctccagagcaaacacagatgatttccttggcgtctgctgtaccctctcagacatctgtgtacttctgtgccagcagtgtgaacgtgtcgacacgagcagtacttcgggccgggcaccaggctcacggtcacaggtgagattcgggcgtctccccaccttccagccccgcatgcat

SEQ ID NO: 1524 - DNA, 239 bp, Artificial Sequence
  Oligonucleotide
atgaattctactcagttggtgctggtatcactgaccaaggagaagtccccaatggctacaatgtctccagatcaaccacagaggatttccctgctgtcggctgctccctcccagacatctgtgtacttctgtgccagcagttgtcatcggtcgacacgagcagtacttcgggccgggcaccaggctcacggtcacaggtgagattcgggcgtctccccaccttccagccccgcatgcat

SEQ ID NO: 1525 - DNA, 239 bp, Artificial Sequence
  Oligonucleotide
atgaattctattcagttggtgctggtatcactgacaaaggagaagtcccgaatggctacaacgtctccagatcaaccacagaggatttccctggagttggctgctccctcccagacatctgtgtacttctgtgccagcagtaggcttgagtcgacacgagcagtacttcgggccgggcaccaggctcacggtcacaggtgagattcgggcgtctccccaccttccagccccgcatgcat

SEQ ID NO: 1526 - DNA, 239 bp, Artificial Sequence
  Oligonucleotide
atgaattctactcagttgctgctgctctcactgacaaaggagaagttcccaatggctacaatgtctccagatcaaacacagaggatttccctggagtcagctgctccctctcagacttctgtttacttctgtgccagcagtacacacgtgtcgacacgagcagtacttcgggccgggcaccaggctcacggtcacaggtgagattcgggcgtctccccaccttccagccccgcatgcat

SEQ ID NO: 1527 - DNA, 239 bp, Artificial Sequence
  Oligonucleotide
atgaattctactactcagctgctgctggtactactgacaaagaagtccccaatggctacaatgtctctagattaaacacagaggatttccctggtgtcggctgctccctcccagacatctgtgtacttgtgtgccagcagttccacagtgtcgacacgagcagtacttcgggccgggcaccaggctcacggtcacaggtgagattcgggcgtctccccaccttccagccccgcatgcat

SEQ ID NO: 1528 - DNA, 239 bp, Artificial Sequence
  Oligonucleotide
atgaattctactcagttgctgctggtatcactgacaaaggagaagtccccgatggctacaatgtatccagatcaaacacagaggatttccctggagtcagctgctccctcccagacatctgtatacttctgtgccagcagtcagtctgtgtcgacacgagcagtacttcgggccgggcaccaggctcacggtcacaggtgagattcgggcgtctccccaccttccagccccgcatgcat

SEQ ID NO: 1529 - DNA, 239 bp, Artificial Sequence
  Oligonucleotide
atgaattcttccaaggcaaggatgcagcagacaaatcggggcttccccgtgatcggttctctgcacagaggtctgagggatccatctccattccagcgcacacagcagggggacttggctgtgtatctctgtgccagcagctccatgtggtcgacacgagcagtacttcgggccgggcaccaggctcacggtcacaggtgagattcgggcgtctccccaccttccagccccgcatgcat

SEQ ID NO: 1530 - DNA, 239 bp, Artificial Sequence
  Oligonucleotide
atgaattcttccaaggcaacagtgcaccagacaaatcagggctgcccagtgatcgcttctctgcagagaggactgggggatccgtctccaatccagcgcacacagcaggaggactcggccgtgtatctctgtgccagcagctcactgcagtcgacacgagcagtacttcgggccgggcaccaggctcacggtcacaggtgagattcgggcgtctccccaccttccagccccgcatgcat

SEQ ID NO: 1531 - DNA, 239 bp, Artificial Sequence
  Oligonucleotide
atgaattcttccaaggcacgggtgcggcagatgactcagggctgcccaacgatcggttctttgcagtcaggcctgagggatccgtctctaatccagcgcacagagcggggggactcagccgtgtatctctgtgccagcagccaagtcacgtcgacacgagcagtacttcgggccgggcaccaggctcacggtcacaggtgagattcgggcgtctccccaccttccagccccgcatgcat

SEQ ID NO: 1532 - DNA, 239 bp, Artificial Sequence
  Oligonucleotide
atgaattctcccagagtgatgctcaacgagacaaatcagggcggcccagtggtcggttctctgcagagaggcctgagagatccgtctccaatccagcgcacagagcagggggactcagctgtgtatctctgtgccagcagctagacggagtcgacacgagcagtacttcgggccgggcaccaggctcacggtcacaggtgagattcgggcgtctccccaccttccagccccgcatgcat

SEQ ID NO: 1533 - DNA, 239 bp, Artificial Sequence
  Oligonucleotide
atgaattcttcaattatgaagcccaacaagacaaatcagggctgcccaatgatcggttctctgcagagaggcctgagggatccatctccaatccagcgcacagagcagcgggactcggccatgtatcgctgtgccagcagcgagcgatagtcgacacgagcagtacttcgggccgggcaccaggctcacggtcacaggtgagattcgggcgtctccccaccttccagccccgcatgcat

SEQ ID NO: 1534 - DNA, 239 bp, Artificial Sequence
  Oligonucleotide
atgaattcttcaattatgaagctcaaccagacaaatcagggctgcccagtgatcggttctctgcagagaggcctgagggatccatctccaattcagcgcacagagcagcgggactcagccatgtatcgctgtgccagcagcctcgagaagtcgacacgagcagtacttcgggccgggcaccaggctcacggtcacaggtgagattcgggcgtctccccaccttccagccccgcatgcat

SEQ ID NO: 1535 - DNA, 239 bp, Artificial Sequence
  Oligonucleotide
atgaattcttccagaatgaagctcaactagacaaatcggggctgcccagtgatcgcttctttgcagaaaggcctgagggatccgtctccaatccagcgcacacagcaggaggactccgccgtgtatctctgtgccagcagcatgacaccgtcgacacgagcagtacttcgggccgggcaccaggctcacggtcacaggtgagattcgggcgtctccccaccttccagccccgcatgcat

SEQ ID NO: 1536 - DNA, 239 bp, Artificial Sequence
  Oligonucleotide
atgaattcttccagaatgaagctcaactagaaaaatcaaggctgctcagtgatcggttctctgcagagaggcctaagggatctttctccaatccagcgcacagagcagggggactcggccatgtatctctgtgccagcagccttcacgagtcgacacgagcagtacttcgggccgggcaccaggctcacggtcacaggtgagattcgggcgtctccccaccttccagccccgcatgcat

SEQ ID NO: 1537 - DNA, 239 bp, Artificial Sequence
  Oligonucleotide
atgaattctcagtattataatggagaagagagagcaaaaggaaacattcttgaacgattctccgcacaacagttccctgacttgcactctcctgagctctctggagctgggggactcagctttgtatttctgtgccagcagcgtagagtgtcgacacgagcagtacttcgggccgggcaccaggctcacggtcacaggtgagattcgggcgtctccccaccttccagccccgcatgcat

SEQ ID NO: 1538 - DNA, 239 bp, Artificial Sequence
  Oligonucleotide
atgaattctactcatatggtgttcacgacactaacaaaggagaagtctcagatggctacagtgtctctagatcaaacacagaggacctccctggagtctgctgcctcctcccagacatctgtatatttctgcgccagcagttcgtcgatgtcgacacgagcagtacttcgggccgggcaccaggctcacggtcacaggtgagattcgggcgtctccccaccttccagccccgcatgcat

SEQ ID NO: 1539 - DNA, 239 bp, Artificial Sequence
  Oligonucleotide
atgaattctactcagcagctgctgatattacagataaaggagaagtccccgatggctatgttgtctccagatccaagacagagaatttccctggagtcagctacccgctcccagacatctgtgtatttctgcgccagcagtagctagtggtcgacacgagcagtacttcgggccgggcaccaggctcacggtcacaggtgagattcgggcgtctccccaccttccagccccgcatgcat

SEQ ID NO: 1540 - DNA, 239 bp, Artificial Sequence
  Oligonucleotide
atgaattctactcatatggtgttaaagatactgacaaaggagaagtctcagatggctatagtgtctctagatcaaagacagaggatttccctggagtccgctaccagctcccagacatctgtgtacttctgtgccatcagttgagacctgtcgacacgagcagtacttcgggccgggcaccaggctcacggtcacaggtgagattcgggcgtctccccaccttccagccccgcatgcat

SEQ ID NO: 1541 - DNA, 239 bp, Artificial Sequence
  Oligonucleotide
atgaattctttcaggatgagagtgtagtagatgattcacagttgcctaaggatcgattttctgcagagaggctcaaaggagtagactccaatccagcctgcagagcttggggactcggccatgtatctctgtgccagcagcgatggcttgtcgacacgagcagtacttcgggccgggcaccaggctcacggtcacaggtgagattcgggcgtctccccaccttccagccccgcatgcat

SEQ ID NO: 1542 - DNA, 239 bp, Artificial Sequence
  Oligonucleotide
atgaattctttcagaataacggtgtagtggatgattcacagttgcctaaggatcgattttctgcagagaggctcaaaggagtagactccaatccagcctgcaaagcttgaggactcggccgtgtatctctgtgccagcagcgcatctgagtcgacacgagcagtacttcgggccgggcaccaggctcacggtcacaggtgagattcgggcgtctccccaccttccagccccgcatgcat

SEQ ID NO: 1543 - DNA, 239 bp, Artificial Sequence
  Oligonucleotide
atgaattctatgagaatgaggaagcagtagacgattcacagttgcctaaggatcgattttctgcagagaggctcaaaggagtagactccaatccagcctgcagagcttggggactcggccgtgtatctctgtgccagcagcgacactctgtcgacacgagcagtacttcgggccgggcaccaggctcacggtcacaggtgagattcgggcgtctccccaccttccagccccgcatgcat

SEQ ID NO: 1544 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttgctacacgtcgacacgagcagtacttcgggccgggcaccaggctcacggtcacaggtgagattcgggcgtctccccaccttccagccccgcatgcat

SEQ ID NO: 1545 - DNA, 239 bp, Artificial Sequence
  Oligonucleotide
atgaattctttaacaacaacgttccgatagatgattcagggatgcccgaggatcgattctcagctaagatgcctaatgcatcattctccaatccagccctcagaacccagggactcagctgtgtacttctgtgccagcagttcagcttggtcgacacgagcagtacttcgggccgggcaccaggctcacggtcacaggtgagattcgggcgtctccccaccttccagccccgcatgcat

SEQ ID NO: 1546 - DNA, 239 bp, Artificial Sequence
  Oligonucleotide
atgaattcttccgcaaccgggctcctctagatgattcggggatgccgaaggatcgattctcagcagagatgcctgatgcaactttagccaatccagccctcagaacccagggactcagctgtgtatttttgtgctagtggtttcggaacgtcgacacgagcagtacttcgggccgggcaccaggctcacggtcacaggtgagattcgggcgtctccccaccttccagccccgcatgcat

SEQ ID NO: 1547 - DNA, 239 bp, Artificial Sequence
  Oligonucleotide
atgaattctcgttttatgaaaagatgcagagcgataaaggaagcatccctgatcgattctcagctcaacagttcagtgactatcattctgatgagctccttggagctgggggactcagccctgtacttctgtgccagcagcgcaattcggtcgacacgagcagtacttcgggccgggcaccaggctcacggtcacaggtgagattcgggcgtctccccaccttccagccccgcatgcat

SEQ ID NO: 1548 - DNA, 239 bp, Artificial Sequence
  Oligonucleotide
atgaattctttgtgaaagagtctaaacaggatgagtccggtatgcccaacaatcgattcttagctgaaaggactggagggacgtattctagtgcagcctgcagaactggaggattctggagtttatttctgtgccagcagccaagaggtgtcgacacgagcagtacttcgggccgggcaccaggctcacggtcacaggtgagattcgggcgtctccccaccttccagccccgcatgcat

SEQ ID NO: 1549 - DNA, 239 bp, Artificial Sequence
  Oligonucleotide
atgaattccactactatgacaaagattttaacaatgaagcagacacccctgataacttccaatccaggaggccgaacacttctttctgctatccgctcaccaggcctgggggacgcagccatgtacctgtgtgccaccagcgaatggacgtcgacacgagcagtacttcgggccgggcaccaggctcacggtcacaggtgagattcgggcgtctccccaccttccagccccgcatgcat

SEQ ID NO: 1550 - DNA, 239 bp, Artificial Sequence
  Oligonucleotide
atgaattcttccagaatgaaaatgtctttgatgaaacaggtatgcccaaggaaagattttcagctaagtgcctcccaaattcaccctgtaatccaggctacgaagcttgaggattcagcagtgtatttttgtgccagcagcaactgccagtcgacacgagcagtacttcgggccgggcaccaggctcacggtcacaggtgagattcgggcgtctccccaccttccagccccgcatgcat

SEQ ID NO: 1551 - DNA, 239 bp, Artificial Sequence
  Oligonucleotide
atgaattctccttccagtaccaaaacattgcagttgattcagggatgcccaaggaacgattcacagctgaaagacctaacggaacgtcttaagatccatcccgcagagccgagggactcagccgtgtatctctacagtagccctagtaggtcgacacgagcagtacttcgggccgggcaccaggctcacggtcacaggtgagattcgggcgtctccccaccttccagccccgcatgcat

SEQ ID NO: 1552 - DNA, 239 bp, Artificial Sequence
  Oligonucleotide
atgaattcctccagaaagaaaatatcatagatgagtcaggaatgccaaaggaacgattttctgctgaatttcccaaagagggccccagcaatccagcaggtagtgcgaggagattcggcagcttatttctgtgccagctcactgacgttgtcgacacgagcagtacttcgggccgggcaccaggctcacggtcacaggtgagattcgggcgtctccccaccttccagccccgcatgcat

SEQ ID NO: 1553 - DNA, 239 bp, Artificial Sequence
  Oligonucleotide
atgaattctactcacagatagtaaatgactttcagaaaggagatatagctgaagggtacagcgtctctcgggagaagaaggaatcctttcgtgacatcggcccaaaagaacccgacagctttctatctctgtgccagtagttgcagacagtcgacacgagcagtacttcgggccgggcaccaggctcacggtcacaggtgagattcgggcgtctccccaccttccagccccgcatgcat

SEQ ID NO: 1554 - DNA, 239 bp, Artificial Sequence
  Oligonucleotide
atgaattctccaatgagggctccaaggccacatacgagcaaggcgtcgagaaggacaagtttctcatcaaccatgcaagcctgaccttgtacagtgaccagtgcccatcctgaagacagcagcttctacatctgcagtgctagttgaccgtcgacacgagcagtacttcgggccgggcaccaggctcacggtcacaggtgagattcgggcgtctccccaccttccagccccgcatgcat

SEQ ID NO: 1555 - DNA, 239 bp, Artificial Sequence
  Oligonucleotide
atgaattcactcctttgatgtcaaagatataaacaaaggagagatctctgatggatacagtgtctctcgacaggcacaggctaaattctctagagtctgccatccccaaccagacagctctttacttctgtgccaccagtggtctcctagtcgacacgagcagtacttcgggccgggcaccaggctcacggtcacaggtgagattcgggcgtctccccaccttccagccccgcatgcat

SEQ ID NO: 1556 - DNA, 239 bp, Artificial Sequence
  Oligonucleotide
atgaattctattcctatggagttaattccacagagaagggagatctttcctctgagtcaacagtctccagaataaggacggagcattttcctggagtctgccaggccctcacatacctctcagtacctctgtgccagcagtctgcaatcgtcgacacgagcagtacttcgggccgggcaccaggctcacggtcacaggtgagattcgggcgtctccccaccttccagccccgcatgcat

SEQ ID NO: 1557 - DNA, 239 bp, Artificial Sequence
  Oligonucleotide
atgaattctattcaatgaatgttgaggtgactgataagggagatgttcctgaagggtacaaagtctctcgaaaagagaagaggaatttccctggagtcgcccagccccaaccagacctctctgtacttctgtgccagcagttgagcgaagtcgacacgagcagtacttcgggccgggcaccaggctcacggtcacaggtgagattcgggcgtctccccaccttccagccccgcatgcat

SEQ ID NO: 1558 - DNA, 239 bp, Artificial Sequence
  Oligonucleotide
atgaattcttctcatatgatgttaaaatgaaagaaaaaggagatattcctgaggggtacagtgtctctagagagaagaaggagcgcttctctggagtccgccagcaccaaccagacatctatgtacctctgtgccagcagtttggactggtcgacacgagcagtacttcgggccgggcaccaggctcacggtcacaggtgagattcgggcgtctccccaccttccagccccgcatgcat

SEQ ID NO: 1559 - DNA, 239 bp, Artificial Sequence
  Oligonucleotide
atgaattcgcaaatcagggctctgaggccacatatgagagtggatttgtcattgacaagtttcccatcagccgcccaaacctaacattctactgtgagcaacatgagccctgaagacagcagcatatatctctgcagcgttagcaatccgtcgacacgagcagtacttcgggccgggcaccaggctcacggtcacaggtgagattcgggcgtctccccaccttccagccccgcatgcat

SEQ ID NO: 1560 - DNA, 239 bp, Artificial Sequence
  Oligonucleotide
atgaattcctcttctactccgttggtattggccagatcagctctgaggtgccccagaatctctcagcctccagaccccaggaccggcagtagttctaagaagctccttctcagtgactctggcttctatctctgtgcctggcgaactacgtcgacacgagcagtacttcgggccgggcaccaggctcacggtcacaggtgagattcgggcgtctccccaccttccagccccgcatgcat

SEQ ID NO: 1561 - DNA, 495 bp, Artificial Sequence
  Oligonucleotide
gccttgccagcccgctcagcaaggtcattgcctcaagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctggtgacaaggtcattgcctcagtcgacattataagaaactctttggcagtggaacaacacttgttgtcacaggtaagtatcggaagaatacaacatttccaaggtaatagagggaaggcaggaaatgcaaggtcattgcctcactgatggcgcgagggaggc

SEQ ID NO: 1562 - DNA, 495 bp, Artificial Sequence
  Oligonucleotide
gccttgccagcccgctcaggcataactttgcctcacagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctggtgagcataactttgcctcagtcgacattataagaaactctttggcagtggaacaacacttgttgtcacaggtaagtatcggaagaatacaacatttccaaggtaatagagggaaggcaggaaatggcataactttgcctcactgatggcgcgagggaggc

SEQ ID NO: 1563 - DNA, 495 bp, Artificial Sequence
  Oligonucleotide
gccttgccagcccgctcagctctgattttgcctcacagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctggtgactctgattttgcctcagtcgacattataagaaactctttggcagtggaacaacacttgttgtcacaggtaagtatcggaagaatacaacatttccaaggtaatagagggaaggcaggaaatgctctgattttgcctcactgatggcgcgagggaggc

SEQ ID NO: 1564 - DNA, 495 bp, Artificial Sequence
  Oligonucleotide
gccttgccagcccgctcagtacgtacgttgcctcacagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctggtgatacgtacgttgcctcagtcgacattataagaaactctttggcagtggaacaacacttgttgtcacaggtaagtatcggaagaatacaacatttccaaggtaatagagggaaggcaggaaatgtacgtacgttgcctcactgatggcgcgagggaggc

SEQ ID NO: 1565 - DNA, 495 bp, Artificial Sequence
  Oligonucleotide
gccttgccagcccgctcagtacgcgttttgcctcacagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctggtgatacgcgttttgcctcagtcgacattataagaaactctttggcagtggaacaacacttgttgtcacaggtaagtatcggaagaatacaacatttccaaggtaatagagggaaggcaggaaatgtacgcgttttgcctcactgatggcgcgagggaggc

SEQ ID NO: 1566 - DNA, 495 bp, Artificial Sequence
  Oligonucleotide
gccttgccagcccgctcagctcagtgattgcctcacagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggtgactcagtgattgcctcagtcgacattataagaaactctttggcagtggaacaacacttgttgtcacaggtaagtatcggaagaatacaacatttccaaggtaatagagggaaggcaggaaatgctcagtgattgcctcactgatggcgcgagggaggc

SEQ ID NO: 1567 - DNA, 495 bp, Artificial Sequence
  Oligonucleotide
gccttgccagcccgctcagtctgatatttgcctcaagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccaccttgatctgatatttgcctcagtcgacattataagaaactctttggcagtggaacaacacttgttgtcacaggtaagtatcggaagaatacaacatttccaaggtaatagagggaaggcaggaaatgtctgatatttgcctcactgatggcgcgagggaggc

SEQ ID NO: 1568 - DNA, 495 bp, Artificial Sequence
  Oligonucleotide
gccttgccagcccgctcagcatatgctttgcctcaagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccaccttgacatatgctttgcctcagtcgacattataagaaactctttggcagtggaacaacacttgttgtcacaggtaagtatcggaagaatacaacatttccaaggtaatagagggaaggcaggaaatgcatatgctttgcctcactgatggcgcgagggaggc

SEQ ID NO: 1569 - DNA, 495 bp, Artificial Sequence
  Oligonucleotide
gccttgccagcccgctcagcgtaattattgcctcacagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggtgacgtaattattgcctcagtcgacattataagaaactctttggcagtggaacaacacttgttgtcacaggtaagtatcggaagaatacaacatttccaaggtaatagagggaaggcaggaaatgcgtaattattgcctcactgatggcgcgagggaggc

SEQ ID NO: 1570 - DNA, 495 bp, Artificial Sequence
  Oligonucleotide
gccttgccagcccgctcagacgtactcttgcctcagcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtggtgaacgtactcttgcctcagtcgacattataagaaactctttggcagtggaacaacacttgttgtcacaggtaagtatcggaagaatacaacatttccaaggtaatagagggaaggcaggaaatgacgtactcttgcctcactgatggcgcgagggaggc

SEQ ID NO: 1571 - DNA, 495 bp, Artificial Sequence
  Oligonucleotide
gccttgccagcccgctcagcttctaagttgcctcattatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgacttctaagttgcctcagtcgacattataagaaactctttggcagtggaacaacacttgttgtcacaggtaagtatcggaagaatacaacatttccaaggtaatagagggaaggcaggaaatgcttctaagttgcctcactgatggcgcgagggaggc

SEQ ID NO: 1572 - DNA, 495 bp, Artificial Sequence
  Oligonucleotide
gccttgccagcccgctcagactatgacttgcctcagggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatttgaactatgacttgcctcagtcgacattataagaaactctttggcagtggaacaacacttgttgtcacaggtaagtatcggaagaatacaacatttccaaggtaatagagggaaggcaggaaatgactatgacttgcctcactgatggcgcgagggaggc

SEQ ID NO: 1573 - DNA, 495 bp, Artificial Sequence
  Oligonucleotide
gccttgccagcccgctcaggacgttaattgcctcatccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctggtgagacgttaattgcctcagtcgacattataagaaactctttggcagtggaacaacacttgttgtcacaggtaagtatcggaagaatacaacatttccaaggtaatagagggaaggcaggaaatggacgttaattgcctcactgatggcgcgagggaggc

SEQ ID NO: 1574 - DNA, 495 bp, Artificial Sequence
  Oligonucleotide
gccttgccagcccgctcagacaagatattgcctcagcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctttgaacaagatattgcctcagtcgacattataagaaactctttggcagtggaacaacacttgttgtcacaggtaagtatcggaagaatacaacatttccaaggtaatagagggaaggcaggaaatgacaagatattgcctcactgatggcgcgagggaggc

SEQ ID NO: 1575 - DNA, 495 bp, Artificial Sequence
  Oligonucleotide
gccttgccagcccgctcagcaaggtcatcgttagcagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctggtgacaaggtcatcgttagcgtcgacattataagaaactctttggcagtggaacaacacttgttgtcacaggtaagtatcggaagaatacaacatttccaaggtaatagagggaaagcaggaaattcaaggtcatcgttagcctgatggcgcgagggaggc

SEQ ID NO: 1576 - DNA, 495 bp, Artificial Sequence
  Oligonucleotide
gccttgccagcccgctcaggcataacttcgttagccagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctggtgagcataacttcgttagcgtcgacattataagaaactctttggcagtggaacaacacttgttgtcacaggtaagtatcggaagaatacaacatttccaaggtaatagagggaaagcaggaaattgcataacttcgttagcctgatggcgcgagggaggc

SEQ ID NO: 1577 - DNA, 495 bp, Artificial Sequence
  Oligonucleotide
gccttgccagcccgctcagctctgatttcgttagccagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctggtgactctgatttcgttagcgtcgacattataagaaactctttggcagtggaacaacacttgttgtcacaggtaagtatcggaagaatacaacatttccaaggtaatagagggaaagcaggaaattctctgatttcgttagcctgatggcgcgagggaggc

SEQ ID NO: 1578 - DNA, 495 bp, Artificial Sequence
  Oligonucleotide
gccttgccagcccgctcagtacgtacgtcgttagccagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctggtgatacgtacgtcgttagcgtcgacattataagaaactctttggcagtggaacaacacttgttgtcacaggtaagtatcggaagaatacaacatttccaaggtaatagagggaaagcaggaaatttacgtacgtcgttagcctgatggcgcgagggaggc

SEQ ID NO: 1579 - DNA, 495 bp, Artificial Sequence
  Oligonucleotide
gccttgccagcccgctcagtacgcgtttcgttagccagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctggtgatacgcgtttcgttagcgtcgacattataagaaactctttggcagtggaacaacacttgttgtcacaggtaagtatcggaagaatacaacatttccaaggtaatagagggaaagcaggaaatttacgcgtttcgttagcctgatggcgcgagggaggc

SEQ ID NO: 1580 - DNA, 495 bp, Artificial Sequence
  Oligonucleotide
gccttgccagcccgctcagctcagtgatcgttagccagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggtgactcagtgatcgttagcgtcgacattataagaaactctttggcagtggaacaacacttgttgtcacaggtaagtatcggaagaatacaacatttccaaggtaatagagggaaagcaggaaattctcagtgatcgttagcctgatggcgcgagggaggc

SEQ ID NO: 1581 - DNA, 495 bp, Artificial Sequence
  Oligonucleotide
gccttgccagcccgctcagtctgatattcgttagcagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccaccttgatctgatattcgttagcgtcgacattataagaaactctttggcagtggaacaacacttgttgtcacaggtaagtatcggaagaatacaacatttccaaggtaatagagggaaagcaggaaatttctgatattcgttagcctgatggcgcgagggaggc

SEQ ID NO: 1582 - DNA, 495 bp, Artificial Sequence
  Oligonucleotide
gccttgccagcccgctcagcatatgcttcgttagcagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccaccttgacatatgcttcgttagcgtcgacattataagaaactctttggcagtggaacaacacttgttgtcacaggtaagtatcggaagaatacaacatttccaaggtaatagagggaaagcaggaaattcatatgcttcgttagcctgatggcgcgagggaggc

SEQ ID NO: 1583 - DNA, 495 bp, Artificial Sequence
  Oligonucleotide
gccttgccagcccgctcagcgtaattatcgttagccagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggtgacgtaattatcgttagcgtcgacattataagaaactctttggcagtggaacaacacttgttgtcacaggtaagtatcggaagaatacaacatttccaaggtaatagagggaaagcaggaaattcgtaattatcgttagcctgatggcgcgagggaggc

SEQ ID NO: 1584 - DNA, 495 bp, Artificial Sequence
  Oligonucleotide
gccttgccagcccgctcagacgtactctcgttagcgcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtggtgaacgtactctcgttagcgtcgacattataagaaactctttggcagtggaacaacacttgttgtcacaggtaagtatcggaagaatacaacatttccaaggtaatagagggaaagcaggaaattacgtactctcgttagcctgatggcgcgagggaggc

SEQ ID NO: 1585 - DNA, 495 bp, Artificial Sequence
  Oligonucleotide
gccttgccagcccgctcagcttctaagtcgttagcttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgacttctaagtcgttagcgtcgacattataagaaactctttggcagtggaacaacacttgttgtcacaggtaagtatcggaagaatacaacatttccaaggtaatagagggaaagcaggaaattcttctaagtcgttagcctgatggcgcgagggaggc

SEQ ID NO: 1586 - DNA, 495 bp, Artificial Sequence
  Oligonucleotide
gccttgccagcccgctcagactatgactcgttagcgggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatttgaactatgactcgttagcgtcgacattataagaaactctttggcagtggaacaacacttgttgtcacaggtaagtatcggaagaatacaacatttccaaggtaatagagggaaagcaggaaattactatgactcgttagcctgatggcgcgagggaggc

SEQ ID NO: 1587 - DNA, 495 bp, Artificial Sequence
  Oligonucleotide
gccttgccagcccgctcaggacgttaatcgttagctccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctggtgagacgttaatcgttagcgtcgacattataagaaactctttggcagtggaacaacacttgttgtcacaggtaagtatcggaagaatacaacatttccaaggtaatagagggaaagcaggaaattgacgttaatcgttagcctgatggcgcgagggaggc

SEQ ID NO: 1588 - DNA, 495 bp, Artificial Sequence
  Oligonucleotide
gccttgccagcccgctcagacaagatatcgttagcgcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctttgaacaagatatcgttagcgtcgacattataagaaactctttggcagtggaacaacacttgttgtcacaggtaagtatcggaagaatacaacatttccaaggtaatagagggaaagcaggaaattacaagatatcgttagcctgatggcgcgagggaggc

SEQ ID NO: 1589 - DNA, 495 bp, Artificial Sequence
  Oligonucleotide
gccttgccagcccgctcagcaaggtcatatagttcagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctggtgacaaggtcatatagttcgtcgacaagagttgggcaaaaaaatcaaggtatttggtcccggaacaaagcttatcattacaggtaagttttctttaaattttgcaatgtaaagaagggatgggagcaaggtcatatagttcctgatggcgcgagggaggc

SEQ ID NO: 1590 - DNA, 495 bp, Artificial Sequence
  Oligonucleotide
gccttgccagcccgctcaggcataacttatagttccagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctggtgagcataacttatagttcgtcgacaagagttgggcaaaaaaatcaaggtatttggtcccggaacaaagcttatcattacaggtaagttttctttaaattttgcaatgtaaagaagggatgggaggcataacttatagttcctgatggcgcgagggaggc

SEQ ID NO: 1591 - DNA, 495 bp, Artificial Sequence
  Oligonucleotide
gccttgccagcccgctcagctctgatttatagttccagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctggtgactctgatttatagttcgtcgacaagagttgggcaaaaaaatcaaggtatttggtcccggaacaaagcttatcattacaggtaagttttctttaaattttgcaatgtaaagaagggatgggagctctgatttatagttcctgatggcgcgagggaggc

SEQ ID NO: 1592 - DNA, 495 bp, Artificial Sequence
  Oligonucleotide
gccttgccagcccgctcagtacgtacgtatagttccagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctggtgatacgtacgtatagttcgtcgacaagagttgggcaaaaaaatcaaggtatttggtcccggaacaaagcttatcattacaggtaagttttctttaaattttgcaatgtaaagaagggatgggagtacgtacgtatagttcctgatggcgcgagggaggc

SEQ ID NO: 1593 - DNA, 495 bp, Artificial Sequence
  Oligonucleotide
gccttgccagcccgctcagtacgcgtttatagttccagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctggtgatacgcgtttatagttcgtcgacaagagttgggcaaaaaaatcaaggtatttggtcccggaacaaagcttatcattacaggtaagttttctttaaattttgcaatgtaaagaagggatgggagtacgcgtttatagttcctgatggcgcgagggaggc

SEQ ID NO: 1594 - DNA, 495 bp, Artificial Sequence
  Oligonucleotide
gccttgccagcccgctcagctcagtgatatagttccagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggtgactcagtgatatagttcgtcgacaagagttgggcaaaaaaatcaaggtatttggtcccggaacaaagcttatcattacaggtaagttttctttaaattttgcaatgtaaagaagggatgggagctcagtgatatagttcctgatggcgcgagggaggc

SEQ ID NO: 1595 - DNA, 495 bp, Artificial Sequence
  Oligonucleotide
gccttgccagcccgctcagtctgatattatagttcagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccaccttgatctgatattatagttcgtcgacaagagttgggcaaaaaaatcaaggtatttggtcccggaacaaagcttatcattacaggtaagttttctttaaattttgcaatgtaaagaagggatgggagtctgatattatagttcctgatggcgcgagggaggc

SEQ ID NO: 1596 - DNA, 495 bp, Artificial Sequence
  Oligonucleotide
gccttgccagcccgctcagcatatgcttatagttcagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccaccttgacatatgcttatagttcgtcgacaagagttgggcaaaaaaatcaaggtatttggtcccggaacaaagcttatcattacaggtaagttttctttaaattttgcaatgtaaagaagggatgggagcatatgcttatagttcctgatggcgcgagggaggc

SEQ ID NO: 1597 - DNA, 495 bp, Artificial Sequence
  Oligonucleotide
gccttgccagcccgctcagcgtaattatatagttccagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggtgacgtaattatatagttcgtcgacaagagttgggcaaaaaaatcaaggtatttggtcccggaacaaagcttatcattacaggtaagttttctttaaattttgcaatgtaaagaagggatgggagcgtaattatatagttcctgatggcgcgagggaggc

SEQ ID NO: 1598 - DNA, 495 bp, Artificial Sequence
  Oligonucleotide
gccttgccagcccgctcagacgtactctatagttcgcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtggtgaacgtactctatagttcgtcgacaagagttgggcaaaaaaatcaaggtatttggtcccggaacaaagcttatcattacaggtaagttttctttaaattttgcaatgtaaagaagggatgggagacgtactctatagttcctgatggcgcgagggaggc

SEQ ID NO: 1599 - DNA, 495 bp, Artificial Sequence
  Oligonucleotide
gccttgccagcccgctcagcttctaagtatagttcttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgacttctaagtatagttcgtcgacaagagttgggcaaaaaaatcaaggtatttggtcccggaacaaagcttatcattacaggtaagttttctttaaattttgcaatgtaaagaagggatgggagcttctaagtatagttcctgatggcgcgagggaggc

SEQ ID NO: 1600 - DNA, 495 bp, Artificial Sequence
  Oligonucleotide
gccttgccagcccgctcagactatgactatagttcgggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatttgaactatgactatagttcgtcgacaagagttgggcaaaaaaatcaaggtatttggtcccggaacaaagcttatcattacaggtaagttttctttaaattttgcaatgtaaagaagggatgggagactatgactatagttcctgatggcgcgagggaggc

SEQ ID NO: 1601 - DNA, 495 bp, Artificial Sequence
  Oligonucleotide
gccttgccagcccgctcaggacgttaatatagttctccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctggtgagacgttaatatagttcgtcgacaagagttgggcaaaaaaatcaaggtatttggtcccggaacaaagcttatcattacaggtaagttttctttaaattttgcaatgtaaagaagggatgggaggacgttaatatagttcctgatggcgcgagggaggc

SEQ ID NO: 1602 - DNA, 495 bp, Artificial Sequence
  Oligonucleotide
gccttgccagcccgctcagacaagatatatagttcgcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctttgaacaagatatatagttcgtcgacaagagttgggcaaaaaaatcaaggtatttggtcccggaacaaagcttatcattacaggtaagttttctttaaattttgcaatgtaaagaagggatgggagacaagatatatagttcctgatggcgcgagggaggc

SEQ ID NO: 1603 - DNA, 495 bp, Artificial Sequence
  Oligonucleotide
gccttgccagcccgctcagcaaggtcatggcgtatagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctggtgacaaggtcatggcgtatgtcgacactggttggttcaagatatttgctgaagggactaagctcatagtaacttcacctggtaagtaacttttctttctgtttttattccagtaatgaaaaactgcaaggtcatggcgtatctgatggcgcgagggaggc

SEQ ID NO: 1604 - DNA, 495 bp, Artificial Sequence
  Oligonucleotide
gccttgccagcccgctcaggcataacttggcgtatcagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctggtgagcataacttggcgtatgtcgacactggttggttcaagatatttgctgaagggactaagctcatagtaacttcacctggtaagtaacttttctttctgtttttattccagtaatgaaaaactggcataacttggcgtatctgatggcgcgagggaggc

SEQ ID NO: 1605 - DNA, 495 bp, Artificial Sequence
  Oligonucleotide
gccttgccagcccgctcagctctgatttggcgtatcagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctggtgactctgatttggcgtatgtcgacactggttggttcaagatatttgctgaagggactaagctcatagtaacttcacctggtaagtaacttttctttctgtttttattccagtaatgaaaaactgctctgatttggcgtatctgatggcgcgagggaggc

SEQ ID NO: 1606 - DNA, 495 bp, Artificial Sequence
  Oligonucleotide
gccttgccagcccgctcagtacgtacgtggcgtatcagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctggtgatacgtacgtggcgtatgtcgacactggttggttcaagatatttgctgaagggactaagctcatagtaacttcacctggtaagtaacttttctttctgtttttattccagtaatgaaaaactgtacgtacgtggcgtatctgatggcgcgagggaggc

SEQ ID NO: 1607 - DNA, 495 bp, Artificial Sequence
  Oligonucleotide
gccttgccagcccgctcagtacgcgtttggcgtatcagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctggtgatacgcgtttggcgtatgtcgacactggttggttcaagatatttgctgaagggactaagctcatagtaacttcacctggtaagtaacttttctttctgtttttattccagtaatgaaaaactgtacgcgtttggcgtatctgatggcgcgagggaggc

SEQ ID NO: 1608 - DNA, 495 bp, Artificial Sequence
  Oligonucleotide
gccttgccagcccgctcagctcagtgatggcgtatcagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggtgactcagtgatggcgtatgtcgacactggttggttcaagatatttgctgaagggactaagctcatagtaacttcacctggtaagtaacttttctttctgtttttattccagtaatgaaaaactgctcagtgatggcgtatctgatggcgcgagggaggc

SEQ ID NO: 1609 - DNA, 495 bp, Artificial Sequence
  Oligonucleotide
gccttgccagcccgctcagtctgatattggcgtatagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccaccttgatctgatattggcgtatgtcgacactggttggttcaagatatttgctgaagggactaagctcatagtaacttcacctggtaagtaacttttctttctgtttttattccagtaatgaaaaactgtctgatattggcgtatctgatggcgcgagggaggc

SEQ ID NO: 1610 - DNA, 495 bp, Artificial Sequence
  Oligonucleotide
gccttgccagcccgctcagcatatgcttggcgtatagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccaccttgacatatgcttggcgtatgtcgacactggttggttcaagatatttgctgaagggactaagctcatagtaacttcacctggtaagtaacttttctttctgtttttattccagtaatgaaaaactgcatatgcttggcgtatctgatggcgcgagggaggc

SEQ ID NO: 1611 - DNA, 495 bp, Artificial Sequence
  Oligonucleotide
gccttgccagcccgctcagcgtaattatggcgtatcagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggtgacgtaattatggcgtatgtcgacactggttggttcaagatatttgctgaagggactaagctcatagtaacttcacctggtaagtaacttttctttctgtttttattccagtaatgaaaaactgcgtaattatggcgtatctgatggcgcgagggaggc

SEQ ID NO: 1612 - DNA, 495 bp, Artificial Sequence
  Oligonucleotide
gccttgccagcccgctcagacgtactctggcgtatgcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtggtgaacgtactctggcgtatgtcgacactggttggttcaagatatttgctgaagggactaagctcatagtaacttcacctggtaagtaacttttctttctgtttttattccagtaatgaaaaactgacgtactctggcgtatctgatggcgcgagggaggc

SEQ ID NO: 1613 - DNA, 495 bp, Artificial Sequence
  Oligonucleotide
gccttgccagcccgctcagcttctaagtggcgtatttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgacttctaagtggcgtatgtcgacactggttggttcaagatatttgctgaagggactaagctcatagtaacttcacctggtaagtaacttttctttctgtttttattccagtaatgaaaaactgcttctaagtggcgtatctgatggcgcgagggaggc

SEQ ID NO: 1614 - DNA, 495 bp, Artificial Sequence
  Oligonucleotide
gccttgccagcccgctcagactatgactggcgtatgggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatttgaactatgactggcgtatgtcgacactggttggttcaagatatttgctgaagggactaagctcatagtaacttcacctggtaagtaacttttctttctgtttttattccagtaatgaaaaactgactatgactggcgtatctgatggcgcgagggaggc

SEQ ID NO: 1615 - DNA, 495 bp, Artificial Sequence
  Oligonucleotide
gccttgccagcccgctcaggacgttaatggcgtattccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctggtgagacgttaatggcgtatgtcgacactggttggttcaagatatttgctgaagggactaagctcatagtaacttcacctggtaagtaacttttctttctgtttttattccagtaatgaaaaactggacgttaatggcgtatctgatggcgcgagggaggc

SEQ ID NO: 1616 - DNA, 495 bp, Artificial Sequence
  Oligonucleotide
gccttgccagcccgctcagacaagatatggcgtatgcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctttgaacaagatatggcgtatgtcgacactggttggttcaagatatttgctgaagggactaagctcatagtaacttcacctggtaagtaacttttctttctgtttttattccagtaatgaaaaactgacaagatatggcgtatctgatggcgcgagggaggc

SEQ ID NO: 1617 - DNA, 495 bp, Artificial Sequence
  Oligonucleotide
gccttgccagcccgctcagcaaggtcatggacatgagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctggtgacaaggtcatggacatggtcgacagtgattggatcaagacgtttgcaaaagggactaggctcatagtaacttcgcctggtaagtaattttttttctgtttttattccagtaatgaaaaactgacaaggtcatggacatgctgatggcgcgagggaggc

SEQ ID NO: 1618 - DNA, 495 bp, Artificial Sequence
  Oligonucleotide
gccttgccagcccgctcaggcataacttggacatgcagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctggtgagcataacttggacatggtcgacagtgattggatcaagacgtttgcaaaagggactaggctcatagtaacttcgcctggtaagtaattttttttctgtttttattccagtaatgaaaaactgagcataacttggacatgctgatggcgcgagggaggc

SEQ ID NO: 1619 - DNA, 495 bp, Artificial Sequence
  Oligonucleotide
gccttgccagcccgctcagctctgatttggacatgcagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctggtgactctgatttggacatggtcgacagtgattggatcaagacgtttgcaaaagggactaggctcatagtaacttcgcctggtaagtaattttttttctgtttttattccagtaatgaaaaactgactctgatttggacatgctgatggcgcgagggaggc

SEQ ID NO: 1620 - DNA, 495 bp, Artificial Sequence
  Oligonucleotide
gccttgccagcccgctcagtacgtacgtggacatgcagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctggtgatacgtacgtggacatggtcgacagtgattggatcaagacgtttgcaaaagggactaggctcatagtaacttcgcctggtaagtaattttttttctgtttttattccagtaatgaaaaactgatacgtacgtggacatgctgatggcgcgagggaggc

SEQ ID NO: 1621 - DNA, 495 bp, Artificial Sequence
  Oligonucleotide
gccttgccagcccgctcagtacgcgtttggacatgcagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctggtgatacgcgtttggacatggtcgacagtgattggatcaagacgtttgcaaaagggactaggctcatagtaacttcgcctggtaagtaattttttttctgtttttattccagtaatgaaaaactgatacgcgtttggacatgctgatggcgcgagggaggc

SEQ ID NO: 1622 - DNA, 495 bp, Artificial Sequence
  Oligonucleotide
gccttgccagcccgctcagctcagtgatggacatgcagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggtgactcagtgatggacatggtcgacagtgattggatcaagacgtttgcaaaagggactaggctcatagtaacttcgcctggtaagtaattttttttctgtttttattccagtaatgaaaaactgactcagtgatggacatgctgatggcgcgagggaggc

SEQ ID NO: 1623 - DNA, 495 bp, Artificial Sequence
  Oligonucleotide
gccttgccagcccgctcagtctgatattggacatgagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccaccttgatctgatattggacatggtcgacagtgattggatcaagacgtttgcaaaagggactaggctcatagtaacttcgcctggtaagtaattttttttctgtttttattccagtaatgaaaaactgatctgatattggacatgctgatggcgcgagggaggc

SEQ ID NO: 1624 - DNA, 495 bp, Artificial Sequence
  Oligonucleotide
gccttgccagcccgctcagcatatgcttggacatgagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccaccttgacatatgcttggacatggtcgacagtgattggatcaagacgtttgcaaaagggactaggctcatagtaacttcgcctggtaagtaattttttttctgtttttattccagtaatgaaaaactgacatatgcttggacatgctgatggcgcgagggaggc

SEQ ID NO: 1625 - DNA, 495 bp, Artificial Sequence
  Oligonucleotide
gccttgccagcccgctcagcgtaattatggacatgcagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggtgacgtaattatggacatggtcgacagtgattggatcaagacgtttgcaaaagggactaggctcatagtaacttcgcctggtaagtaattttttttctgtttttattccagtaatgaaaaactgacgtaattatggacatgctgatggcgcgagggaggc

SEQ ID NO: 1626 - DNA, 495 bp, Artificial Sequence
  Oligonucleotide
gccttgccagcccgctcagacgtactctggacatggcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtggtgaacgtactctggacatggtcgacagtgattggatcaagacgtttgcaaaagggactaggctcatagtaacttcgcctggtaagtaattttttttctgtttttattccagtaatgaaaaactgaacgtactctggacatgctgatggcgcgagggaggc

SEQ ID NO: 1627 - DNA, 495 bp, Artificial Sequence
  Oligonucleotide
gccttgccagcccgctcagcttctaagtggacatgttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgacttctaagtggacatggtcgacagtgattggatcaagacgtttgcaaaagggactaggctcatagtaacttcgcctggtaagtaattttttttctgtttttattccagtaatgaaaaactgacttctaagtggacatgctgatggcgcgagggaggc

SEQ ID NO: 1628 - DNA, 495 bp, Artificial Sequence
  Oligonucleotide
gccttgccagcccgctcagactatgactggacatggggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatttgaactatgactggacatggtcgacagtgattggatcaagacgtttgcaaaagggactaggctcatagtaacttcgcctggtaagtaattttttttctgtttttattccagtaatgaaaaactgaactatgactggacatgctgatggcgcgagggaggc

SEQ ID NO: 1629 - DNA, 495 bp, Artificial Sequence
  Oligonucleotide
gccttgccagcccgctcaggacgttaatggacatgtccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctggtgagacgttaatggacatggtcgacagtgattggatcaagacgtttgcaaaagggactaggctcatagtaacttcgcctggtaagtaattttttttctgtttttattccagtaatgaaaaactgagacgttaatggacatgctgatggcgcgagggaggc

SEQ ID NO: 1630 - DNA, 495 bp, Artificial Sequence
  Oligonucleotide
gccttgccagcccgctcagacaagatatggacatggcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctttgaacaagatatggacatggtcgacagtgattggatcaagacgtttgcaaaagggactaggctcatagtaacttcgcctggtaagtaattttttttctgtttttattccagtaatgaaaaactgaacaagatatggacatgctgatggcgcgagggaggc

SEQ ID NO: 1631 - DNA, 35 bp, Artificial Sequence
  Oligonucleotide
ttacctacaactgtgagtctggtgccttgtccaaa

SEQ ID NO: 1632 - DNA, 33 bp, Artificial Sequence
  Oligonucleotide
acctacaacggttaacctggtccccgaaccgaa

SEQ ID NO: 1633 - DNA, 33 bp, Artificial Sequence
  Oligonucleotide
acctacaacagtgagccaacttccctctccaaa

SEQ ID NO: 1634 - DNA, 31 bp, Artificial Sequence
  Oligonucleotide
ccaagacagagagctgggttccactgccaaa

SEQ ID NO: 1635 - DNA, 33 bp, Artificial Sequence
  Oligonucleotide
acctaggatggagagtcgagtcccatcaccaaa

SEQ ID NO: 1636 - DNA, 31 bp, Artificial Sequence
  Oligonucleotide
ctgtcacagtgagcctggtcccgttcccaaa

SEQ ID NO: 1637 - DNA, 25 bp, Artificial Sequence
  Oligonucleotide
cggtgagccgtgtccctggcccgaa

SEQ ID NO: 1638 - DNA, 31 bp, Artificial Sequence
  Oligonucleotide
ccagtacggtcagcctagagccttctccaaa

SEQ ID NO: 1639 - DNA, 26 bp, Artificial Sequence
  Oligonucleotide
actgtcagccgggtgcctgggccaaa

SEQ ID NO: 1640 - DNA, 22 bp, Artificial Sequence
  Oligonucleotide
agagccgggtcccggcgccgaa

SEQ ID NO: 1641 - DNA, 22 bp, Artificial Sequence
  Oligonucleotide
ggagccgcgtgcctggcccgaa

SEQ ID NO: 1642 - DNA, 23 bp, Artificial Sequence
  Oligonucleotide
gtcagcctgctgccggccccgaa

SEQ ID NO: 1643 - DNA, 23 bp, Artificial Sequence
  Oligonucleotide
gtgagcctggtgcccggcccgaa

SEQ ID NO: 1644 - DNA, 29 bp, Artificial Sequence
  Oligonucleotide
aacaaaggagaagtctcagatggctacag

SEQ ID NO: 1645 - DNA, 29 bp, Artificial Sequence
  Oligonucleotide
gataaaggagaagtccccgatggctatgt

SEQ ID NO: 1646 - DNA, 29 bp, Artificial Sequence
  Oligonucleotide
gacaaaggagaagtctcagatggctatag

SEQ ID NO: 1647 - DNA, 29 bp, Artificial Sequence
  Oligonucleotide
gccaaaggagaggtccctgatggctacaa

SEQ ID NO: 1648 - DNA, 29 bp, Artificial Sequence
  Oligonucleotide
ctctagattaaacacagaggatttcccac

SEQ ID NO: 1649 - DNA, 29 bp, Artificial Sequence
  Oligonucleotide
aaggagaagtccccgatggctacaatgta

SEQ ID NO: 1650 - DNA, 29 bp, Artificial Sequence
  Oligonucleotide
aaggagaagtccccaatggctacaatgtc

SEQ ID NO: 1651 - DNA, 30 bp, Artificial Sequence
  Oligonucleotide
gacaaaggagaagtcccgaatggctacaac

SEQ ID NO: 1652 - DNA, 29 bp, Artificial Sequence
  Oligonucleotide
gttcccaatggctacaatgtctccagatc

SEQ ID NO: 1653 - DNA, 29 bp, Artificial Sequence
  Oligonucleotide
gtccccaatggctacaatgtctccagatt

SEQ ID NO: 1654 - DNA, 29 bp, Artificial Sequence
  Oligonucleotide
gtccctgatggttatagtgtctccagagc

SEQ ID NO: 1655 - DNA, 29 bp, Artificial Sequence
  Oligonucleotide
atctctgatggatacagtgtctctcgaca

SEQ ID NO: 1656 - DNA, 29 bp, Artificial Sequence
  Oligonucleotide
tttcctctgagtcaacagtctccagaata

SEQ ID NO: 1657 - DNA, 29 bp, Artificial Sequence
  Oligonucleotide
tcctgaagggtacaaagtctctcgaaaag

SEQ ID NO: 1658 - DNA, 29 bp, Artificial Sequence
  Oligonucleotide
ctctgagaggtatcatgtttcttgaaata

SEQ ID NO: 1659 - DNA, 29 bp, Artificial Sequence
  Oligonucleotide
tcctgaggggtacagtgtctctagagaga

SEQ ID NO: 1660 - DNA, 29 bp, Artificial Sequence
  Oligonucleotide
tatagctgaagggtacagcgtctctcggg

SEQ ID NO: 1661 - DNA, 29 bp, Artificial Sequence
  Oligonucleotide
ctgaatgccccaacagctctctcttaaac

SEQ ID NO: 1662 - DNA, 29 bp, Artificial Sequence
  Oligonucleotide
ctgaatgccccaacagctctcacttattc

SEQ ID NO: 1663 - DNA, 29 bp, Artificial Sequence
  Oligonucleotide
cctgaatgccctgacagctctcgcttata

SEQ ID NO: 1664 - DNA, 29 bp, Artificial Sequence
  Oligonucleotide
cctaaatctccagacaaagctcacttaaa

SEQ ID NO: 1665 - DNA, 28 bp, Artificial Sequence
  Oligonucleotide
ctcacctgactctccagacaaagctcat

SEQ ID NO: 1666 - DNA, 29 bp, Artificial Sequence
  Oligonucleotide
ttcagctaagtgcctcccaaattcaccct

SEQ ID NO: 1667 - DNA, 28 bp, Artificial Sequence
  Oligonucleotide
gattctcatctcaatgccccaagaacgc

SEQ ID NO: 1668 - DNA, 29 bp, Artificial Sequence
  Oligonucleotide
attttctgctgaatttcccaaagagggcc

SEQ ID NO: 1669 - DNA, 29 bp, Artificial Sequence
  Oligonucleotide
attcacagctgaaagacctaacggaacgt

SEQ ID NO: 1670 - DNA, 29 bp, Artificial Sequence
  Oligonucleotide
tcttagctgaaaggactggagggacgtat

SEQ ID NO: 1671 - DNA, 29 bp, Artificial Sequence
  Oligonucleotide
ttcgatgatcaattctcagttgaaaggcc

SEQ ID NO: 1672 - DNA, 27 bp, Artificial Sequence
  Oligonucleotide
ttgattctcagcacagatgcctgatgt

SEQ ID NO: 1673 - DNA, 27 bp, Artificial Sequence
  Oligonucleotide
gcgattctcagctgagaggcctgatgg

SEQ ID NO: 1674 - DNA, 27 bp, Artificial Sequence
  Oligonucleotide
tcgattctcagctaagatgcctaatgc

SEQ ID NO: 1675 - DNA, 30 bp, Artificial Sequence
  Oligonucleotide
ttctcagcagagatgcctgatgcaacttta

SEQ ID NO: 1676 - DNA, 29 bp, Artificial Sequence
  Oligonucleotide
ggttctctgcagagaggcctaagggatct

SEQ ID NO: 1677 - DNA, 29 bp, Artificial Sequence
  Oligonucleotide
gctgcccagtgatcgcttctttgcagaaa

SEQ ID NO: 1678 - DNA, 29 bp, Artificial Sequence
  Oligonucleotide
ggcggcccagtggtcggttctctgcagag

SEQ ID NO: 1679 - DNA, 30 bp, Artificial Sequence
  Oligonucleotide
atgatcggttctctgcagagaggcctgagg

SEQ ID NO: 1680 - DNA, 29 bp, Artificial Sequence
  Oligonucleotide
agtgatcgcttctctgcagagaggactgg

SEQ ID NO: 1681 - DNA, 28 bp, Artificial Sequence
  Oligonucleotide
ggctgcccaacgatcggttctttgcagt

SEQ ID NO: 1682 - DNA, 29 bp, Artificial Sequence
  Oligonucleotide
tccccgtgatcggttctctgcacagaggt

SEQ ID NO: 1683 - DNA, 29 bp, Artificial Sequence
  Oligonucleotide
ctaaggatcgattttctgcagagaggctc

SEQ ID NO: 1684 - DNA, 29 bp, Artificial Sequence
  Oligonucleotide
ctgatcgattctcagctcaacagttcagt

SEQ ID NO: 1685 - DNA, 29 bp, Artificial Sequence
  Oligonucleotide
tggtcgattctcagggcgccagttctcta

SEQ ID NO: 1686 - DNA, 29 bp, Artificial Sequence
  Oligonucleotide
taatcgattctcagggcgccagttccatg

SEQ ID NO: 1687 - DNA, 29 bp, Artificial Sequence
  Oligonucleotide
tcctagattctcaggtctccagttcccta

SEQ ID NO: 1688 - DNA, 29 bp, Artificial Sequence
  Oligonucleotide
ggaaacttccctcctagattttcaggtcg

SEQ ID NO: 1689 - DNA, 30 bp, Artificial Sequence
  Oligonucleotide
aagaggaaacttccctgatcgattctcagc

SEQ ID NO: 1690 - DNA, 29 bp, Artificial Sequence
  Oligonucleotide
ggcaacttccctgatcgattctcaggtca

SEQ ID NO: 1691 - DNA, 28 bp, Artificial Sequence
  Oligonucleotide
gttccctgacttgcactctgaactaaac

SEQ ID NO: 1692 - DNA, 28 bp, Artificial Sequence
  Oligonucleotide
gccgaacacttctttctgctttcttgac

SEQ ID NO: 1693 - DNA, 29 bp, Artificial Sequence
  Oligonucleotide
gaccccaggaccggcagttcatcctgagt

SEQ ID NO: 1694 - DNA, 29 bp, Artificial Sequence
  Oligonucleotide
atgcaagcctgaccttgtccactctgaca

SEQ ID NO: 1695 - DNA, 29 bp, Artificial Sequence
  Oligonucleotide
catcagccgcccaaacctaacattctcaa

SEQ ID NO: 1696 - DNA, 33 bp, Artificial Sequence
  Oligonucleotide
acaactgtgagtctggtgccttgtccaaagaaa

SEQ ID NO: 1697 - DNA, 33 bp, Artificial Sequence
  Oligonucleotide
acaacggttaacctggtccccgaaccgaaggtg

SEQ ID NO: 1698 - DNA, 33 bp, Artificial Sequence
  Oligonucleotide
acaacagtgagccaacttccctctccaaaatat

SEQ ID NO: 1699 - DNA, 33 bp, Artificial Sequence
  Oligonucleotide
aagacagagagctgggttccactgccaaaaaac

SEQ ID NO: 1700 - DNA, 33 bp, Artificial Sequence
  Oligonucleotide
aggatggagagtcgagtcccatcaccaaaatgc

SEQ ID NO: 1701 - DNA, 33 bp, Artificial Sequence
  Oligonucleotide
gtcacagtgagcctggtcccgttcccaaagtgg

SEQ ID NO: 1702 - DNA, 33 bp, Artificial Sequence
  Oligonucleotide
agcacggtgagccgtgtccctggcccgaagaac

SEQ ID NO: 1703 - DNA, 33 bp, Artificial Sequence
  Oligonucleotide
agtacggtcagcctagagccttctccaaaaaac

SEQ ID NO: 1704 - DNA, 33 bp, Artificial Sequence
  Oligonucleotide
agcactgtcagccgggtgcctgggccaaaatac

SEQ ID NO: 1705 - DNA, 33 bp, Artificial Sequence
  Oligonucleotide
agcactgagagccgggtcccggcgccgaagtac

SEQ ID NO: 1706 - DNA, 33 bp, Artificial Sequence
  Oligonucleotide
agcaccaggagccgcgtgcctggcccgaagtac

SEQ ID NO: 1707 - DNA, 33 bp, Artificial Sequence
  Oligonucleotide
agcacggtcagcctgctgccggccccgaaagtc

SEQ ID NO: 1708 - DNA, 33 bp, Artificial Sequence
  Oligonucleotide
gtgaccgtgagcctggtgcccggcccgaagtac

SEQ ID NO: 1709 - DNA, 33 bp, Artificial Sequence; identical to SEQ ID NO: 1708
  Oligonucleotide

SEQ ID NO: 1710 - DNA, 18 bp, Artificial Sequence
  Oligonucleotide
aatacgactcactatagg

SEQ ID NO: 1711 - DNA, 19 bp, Artificial Sequence
  Oligonucleotide
gctagttattgctcagcgg

SEQ ID NO: 1712 - DNA, 18 bp, Artificial Sequence
  Oligonucleotide
attaaccctcactaaagg

SEQ ID NO: 1713 - DNA, 19 bp, Artificial Sequence
  Oligonucleotide
gatttaggtgacactatag

SEQ ID NO: 1714 - DNA, 18 bp, Artificial Sequence
  Oligonucleotide
tgtaaaacgacggccagt

SEQ ID NO: 1715 - DNA, 17 bp, Artificial Sequence
  Oligonucleotide
gttttcccagtcacgac

SEQ ID NO: 1716 - DNA, 18 bp, Artificial Sequence
  Oligonucleotide
caggaaacagctatgacc

SEQ ID NO: 1717 - DNA, 21 bp, Artificial Sequence
  Oligonucleotide
gactggttccaattgacaagc

SEQ ID NO: 1718 - DNA, 21 bp, Artificial Sequence
  Oligonucleotide
gcaaatggcattctgacatcc

SEQ ID NO: 1719 - DNA, 23 bp, Artificial Sequence
  Oligonucleotide
gggctggcaagccacgtttggtg

SEQ ID NO: 1720 - DNA, 23 bp, Artificial Sequence
  Oligonucleotide
ccgggagctgcatgtgtcagagg

SEQ ID NO: 1721 - DNA, 22 bp, Artificial Sequence
  Oligonucleotide
aactagaaggcacagtcgaggc

SEQ ID NO: 1722 - DNA, 20 bp, Artificial Sequence
  Oligonucleotide
cactctcggcatggacgagc

SEQ ID NO: 1723 - DNA, 20 bp, Artificial Sequence
  Oligonucleotide
tggtgcagatgaacttcagg

SEQ ID NO: 1724 - DNA, 20 bp, Artificial Sequence
  Oligonucleotide
gttcgaccccgcctcgatcc

SEQ ID NO: 1725 - DNA, 21 bp, Artificial Sequence
  Oligonucleotide
tgacacacattccacagggtc

SEQ ID NO: 1726 - DNA, 19 bp, Artificial Sequence
  Oligonucleotide
gcgtgaatgtaagcgtgac

SEQ ID NO: 1727 - DNA, 21 bp, Artificial Sequence
  Oligonucleotide
dggattattcataccgtccca

SEQ ID NO: 1728 - DNA, 21 bp, Artificial Sequence
  Oligonucleotide
dcaaatgtggtatggctgatt

SEQ ID NO: 1729 - DNA, 21 bp, Artificial Sequence
  Oligonucleotide
datgccatagcatttttatcc

SEQ ID NO: 1730 - DNA, 19 bp, Artificial Sequence
  Oligonucleotide
dgatttaatctgtatcagg

SEQ ID NO: 1731 - DNA, 22 bp, Artificial Sequence
  Oligonucleotide
dcgcaaatgggcggtaggcgtg

SEQ ID NO: 1732 - DNA, 26 bp, Artificial Sequence
  Oligonucleotide
ggaggggaaggccccacagtgtcttc

SEQ ID NO: 1733 - DNA, 26 bp, Artificial Sequence
  Oligonucleotide
ggaggggaaggccccacagcgtcttc

SEQ ID NO: 1734 - DNA, 26 bp, Artificial Sequence
  Oligonucleotide
ggaggggaagaccccacagcatcttc

SEQ ID NO: 1735 - DNA, 26 bp, Artificial Sequence
  Oligonucleotide
ggaggggaaggccccacagcatcttc

SEQ ID NO: 1736 - DNA, 26 bp, Artificial Sequence
  Oligonucleotide
ggcggggaaggccccacagcatcttc

SEQ ID NO: 1737 - DNA, 27 bp, Artificial Sequence
  Oligonucleotide
tgaagtcatacagttcctggtgtccat

SEQ ID NO: 1738 - DNA, 28 bp, Artificial Sequence
  Oligonucleotide
ccaaatcaggctttggagcacctgatct

SEQ ID NO: 1739 - DNA, 27 bp, Artificial Sequence
  Oligonucleotide
caaaggcttagaatatttattacatgt

SEQ ID NO: 1740 - DNA, 27 bp, Artificial Sequence
  Oligonucleotide
ccaggtccctgaggcactccaccagct

SEQ ID NO: 1741 - DNA, 28 bp, Artificial Sequence
  Oligonucleotide
ctgaatctaaattatgagccatctgaca

SEQ ID NO: 1742 - DNA, 34 bp, Artificial Sequence
  Oligonucleotide
gtgaagttactatgagcttagtcccttcagcaaa

SEQ ID NO: 1743 - DNA, 33 bp, Artificial Sequence
  Oligonucleotide
cgaagttactatgagcctagtcccttttgcaaa

SEQ ID NO: 1744 - DNA, 28 bp, Artificial Sequence
  Oligonucleotide
tgacaacaagtgttgttccactgccaaa

SEQ ID NO: 1745 - DNA, 31 bp, Artificial Sequence
  Oligonucleotide
ctgtaatgataagctttgttccgggaccaaa

SEQ ID NO: 1746 - DNA, 19 bp, Artificial Sequence
  Oligonucleotide
gccttgccagcccgctcag

SEQ ID NO: 1747 - DNA, 49 bp, Artificial Sequence
  Oligonucleotide
caagcagaagacggcatacgagatcggtctgccttgccagcccgctcag

SEQ ID NO: 1748 - DNA, 16 bp, Artificial Sequence
  Oligonucleotide
acacacgtgacactct

SEQ ID NO: 1749 - DNA, 300 bp, Artificial Sequence
  Oligonucleotide
tcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcag

SEQ ID NO: 1750 - DNA, 100 bp, Artificial Sequence
  Oligonucleotide
actgaagctttctttggacaaggcaccagactcacagttgtaggtaagacatttttcaggttcttttgcagatccgtcacagggaaaagtgggtccacag

SEQ ID NO: 1751 - DNA, 19 bp, Artificial Sequence
  Oligonucleotide
ctgatggcgcgagggaggc

SEQ ID NO: 1752 - DNA, 48 bp, Artificial Sequence
  Oligonucleotide
aatgatacggcgaccaccgagatctacacgcctccctcgcgccatcag

SEQ ID NO: 1753 - DNA, 63 bp, Artificial Sequence
  Oligonucleotide
caagcagaagacggcatacgagctcttccgatctaacaaaggagaagtctcagatggctacag

SEQ ID NO: 1754 - DNA, 63 bp, Artificial Sequence
  Oligonucleotide
caagcagaagacggcatacgagctcttccgatctgataaaggagaagtccccgatggctatgt

SEQ ID NO: 1755 - DNA, 63 bp, Artificial Sequence
  Oligonucleotide
caagcagaagacggcatacgagctcttccgatctgacaaaggagaagtctcagatggctatag

SEQ ID NO: 1756 - DNA, 63 bp, Artificial Sequence
  Oligonucleotide
caagcagaagacggcatacgagctcttccgatctctaaggatcgattttctgcagagaggctc

SEQ ID NO: 1757 - DNA, 61 bp, Artificial Sequence
  Oligonucleotide
caagcagaagacggcatacgagctcttccgatctttgattctcagcacagatgcctgatgt

SEQ ID NO: 1758 - DNA, 61 bp, Artificial Sequence
  Oligonucleotide
caagcagaagacggcatacgagctcttccgatctgcgattctcagctgagaggcctgatgg

SEQ ID NO: 1759 - DNA, 61 bp, Artificial Sequence
  Oligonucleotide
caagcagaagacggcatacgagctcttccgatcttcgattctcagctaagatgcctaatgc

SEQ ID NO: 1760 - DNA, 64 bp, Artificial Sequence
  Oligonucleotide
caagcagaagacggcatacgagctcttccgatctttctcagcagagatgcctgatgcaacttta

SEQ ID NO: 1761 - DNA, 63 bp, Artificial Sequence
  Oligonucleotide
caagcagaagacggcatacgagctcttccgatctctgatcgattctcagctcaacagttcagt

SEQ ID NO: 1762 - DNA, 63 bp, Artificial Sequence
  Oligonucleotide
caagcagaagacggcatacgagctcttccgatcttcttagctgaaaggactggagggacgtat

SEQ ID NO: 1763 - DNA, 62 bp, Artificial Sequence
  Oligonucleotide
caagcagaagacggcatacgagctcttccgatctgccgaacacttctttctgctttcttgac

SEQ ID NO: 1764 - DNA, 63 bp, Artificial Sequence
  Oligonucleotide
caagcagaagacggcatacgagctcttccgatctttcagctaagtgcctcccaaattcaccct

SEQ ID NO: 1765 - DNA, 63 bp, Artificial Sequence
  Oligonucleotide
caagcagaagacggcatacgagctcttccgatctattcacagctgaaagacctaacggaacgt

SEQ ID NO: 1766 - DNA, 63 bp, Artificial Sequence
  Oligonucleotide
caagcagaagacggcatacgagctcttccgatctattttctgctgaatttcccaaagagggcc

SEQ ID NO: 1767 - DNA, 63 bp, Artificial Sequence
  Oligonucleotide
caagcagaagacggcatacgagctcttccgatcttatagctgaagggtacagcgtctctcggg

SEQ ID NO: 1768 - DNA, 63 bp, Artificial Sequence
  Oligonucleotide
caagcagaagacggcatacgagctcttccgatctttcgatgatcaattctcagttgaaaggcc

SEQ ID NO: 1769 - DNA, 63 bp, Artificial Sequence
  Oligonucleotide
caagcagaagacggcatacgagctcttccgatctatgcaagcctgaccttgtccactctgaca

SEQ ID NO: 1770 - DNA, 62 bp, Artificial Sequence
  Oligonucleotide
caagcagaagacggcatacgagctcttccgatctgattctcatctcaatgccccaagaacgc

SEQ ID NO: 1771 - DNA, 63 bp, Artificial Sequence
  Oligonucleotide
caagcagaagacggcatacgagctcttccgatctatctctgatggatacagtgtctctcgaca

SEQ ID NO: 1772 - DNA, 63 bp, Artificial Sequence
  Oligonucleotide
caagcagaagacggcatacgagctcttccgatcttttcctctgagtcaacagtctccagaata

SEQ ID NO: 1773 - DNA, 63 bp, Artificial Sequence
  Oligonucleotide
caagcagaagacggcatacgagctcttccgatctctctgagaggtatcatgtttcttgaaata

SEQ ID NO: 1774 - DNA, 63 bp, Artificial Sequence
  Oligonucleotide
caagcagaagacggcatacgagctcttccgatcttcctgaagggtacaaagtctctcgaaaag

SEQ ID NO: 1775 - DNA, 63 bp, Artificial Sequence
  Oligonucleotide
caagcagaagacggcatacgagctcttccgatcttcctgaggggtacagtgtctctagagaga

SEQ ID NO: 1776 - DNA, 63 bp, Artificial Sequence
  Oligonucleotide
caagcagaagacggcatacgagctcttccgatctcatcagccgcccaaacctaacattctcaa

SEQ ID NO: 1777 - DNA, 63 bp, Artificial Sequence
  Oligonucleotide
caagcagaagacggcatacgagctcttccgatctcctgaatgccctgacagctctcgcttata

SEQ ID NO: 1778 - DNA, 63 bp, Artificial Sequence
  Oligonucleotide
caagcagaagacggcatacgagctcttccgatctcctaaatctccagacaaagctcacttaaa

SEQ ID NO: 1779 - DNA, 62 bp, Artificial Sequence
  Oligonucleotide
caagcagaagacggcatacgagctcttccgatctctcacctgactctccagacaaagctcat

SEQ ID NO: 1780 - DNA, 63 bp, Artificial Sequence
  Oligonucleotide
caagcagaagacggcatacgagctcttccgatctgaccccaggaccggcagttcatcctgagt

SEQ ID NO: 1781 - DNA, 63 bp, Artificial Sequence
  Oligonucleotide
caagcagaagacggcatacgagctcttccgatctctgaatgccccaacagctctctcttaaac

SEQ ID NO: 1782 - DNA, 63 bp, Artificial Sequence
  Oligonucleotide
caagcagaagacggcatacgagctcttccgatctctgaatgccccaacagctctcacttattc

SEQ ID NO: 1783 - DNA, 63 bp, Artificial Sequence
  Oligonucleotide
caagcagaagacggcatacgagctcttccgatcttggtcgattctcagggcgccagttctcta

SEQ ID NO: 1784 - DNA, 63 bp, Artificial Sequence
  Oligonucleotide
caagcagaagacggcatacgagctcttccgatcttaatcgattctcagggcgccagttccatg

SEQ ID NO: 1785 - DNA, 63 bp, Artificial Sequence
  Oligonucleotide
caagcagaagacggcatacgagctcttccgatcttcctagattctcaggtctccagttcccta

SEQ ID NO: 1786 - DNA, 64 bp, Artificial Sequence
  Oligonucleotide
caagcagaagacggcatacgagctcttccgatctaagaggaaacttccctgatcgattctcagc

SEQ ID NO: 1787 - DNA, 63 bp, Artificial Sequence
  Oligonucleotide
caagcagaagacggcatacgagctcttccgatctggcaacttccctgatcgattctcaggtca

SEQ ID NO: 1788 - DNA, 63 bp, Artificial Sequence
  Oligonucleotide
caagcagaagacggcatacgagctcttccgatctggaaacttccctcctagattttcaggtcg

SEQ ID NO: 1789 - DNA, 63 bp, Artificial Sequence
  Oligonucleotide
caagcagaagacggcatacgagctcttccgatctgtccccaatggctacaatgtctccagatt

SEQ ID NO: 1790 - DNA, 63 bp, Artificial Sequence
  Oligonucleotide
caagcagaagacggcatacgagctcttccgatctgccaaaggagaggtccctgatggctacaa

SEQ ID NO: 1791 - DNA, 63 bp, Artificial Sequence
  Oligonucleotide
caagcagaagacggcatacgagctcttccgatctgtccctgatggttatagtgtctccagagc

SEQ ID NO: 1792 - DNA, 63 bp, Artificial Sequence
  Oligonucleotide
caagcagaagacggcatacgagctcttccgatctaaggagaagtccccaatggctacaatgtc

SEQ ID NO: 1793 - DNA, 64 bp, Artificial Sequence
  Oligonucleotide
caagcagaagacggcatacgagctcttccgatctgacaaaggagaagtcccgaatggctacaac

SEQ ID NO: 1794 - DNA, 63 bp, Artificial Sequence
  Oligonucleotide
caagcagaagacggcatacgagctcttccgatctgttcccaatggctacaatgtctccagatc

SEQ ID NO: 1795 - DNA, 63 bp, Artificial Sequence
  Oligonucleotide
caagcagaagacggcatacgagctcttccgatctctctagattaaacacagaggatttcccac

SEQ ID NO: 1796 - DNA, 63 bp, Artificial Sequence
  Oligonucleotide
caagcagaagacggcatacgagctcttccgatctaaggagaagtccccgatggctacaatgta

SEQ ID NO: 1797 - DNA, 63 bp, Artificial Sequence
  Oligonucleotide
caagcagaagacggcatacgagctcttccgatcttccccgtgatcggttctctgcacagaggt

SEQ ID NO: 1798 - DNA, 63 bp, Artificial Sequence
  Oligonucleotide
caagcagaagacggcatacgagctcttccgatctagtgatcgcttctctgcagagaggactgg

SEQ ID NO: 1799 - DNA, 62 bp, Artificial Sequence
  Oligonucleotide
caagcagaagacggcatacgagctcttccgatctggctgcccaacgatcggttctttgcagt

SEQ ID NO: 1800 - DNA, 63 bp, Artificial Sequence
  Oligonucleotide
caagcagaagacggcatacgagctcttccgatctggcggcccagtggtcggttctctgcagag

SEQ ID NO: 1801 - DNA, 64 bp, Artificial Sequence
  Oligonucleotide
caagcagaagacggcatacgagctcttccgatctatgatcggttctctgcagagaggcctgagg

SEQ ID NO: 1802 - DNA, 63 bp, Artificial Sequence
  Oligonucleotide
caagcagaagacggcatacgagctcttccgatctgctgcccagtgatcgcttctttgcagaaa

SEQ ID NO: 1803 - DNA, 63 bp, Artificial Sequence
  Oligonucleotide
caagcagaagacggcatacgagctcttccgatctggttctctgcagagaggcctaagggatct

SEQ ID NO: 1804 - DNA, 62 bp, Artificial Sequence
  Oligonucleotide
caagcagaagacggcatacgagctcttccgatctgttccctgacttgcactctgaactaaac

SEQ ID NO: 1805 - DNA, 495 bp, Artificial Sequence
  Oligonucleotide
gcctccctcgcgccatcagagagtgtccttggttacttgcctggcccagtacacctggctccccgctatccccagacagcagactcacctgaggagacggtgaccagggtgccctggccccagtgctggaagtatgtcgacagagtgtccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccagagtgtccttggttactgagcgggctggcaaggc

SEQ ID NO: 1806 - DNA, 495 bp, Artificial Sequence
  Oligonucleotide
gcctccctcgcgccatcagagagtgtcacctcttgcttgcctggcccagtacacctggctccccgctatccccagacagcagactcacctgaggagacggtgaccagggtgccctggccccagtgctggaagtatgtcgacagagtgtcacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccagagtgtcacctcttgctgagcgggctggcaaggc

SEQ ID NO: 1807 - DNA, 495 bp, Artificial Sequence
  Oligonucleotide
gcctccctcgcgccatcagagagtgtcctgattctcttgcctggcccagtacacctggctccccgctatccccagacagcagactcacctgaggagacggtgaccagggtgccctggccccagtgctggaagtatgtcgacagagtgtcctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccagagtgtcctgattctctgagcgggctggcaaggc

SEQ ID NO: 1808 - DNA, 495 bp, Artificial Sequence
  Oligonucleotide
gcctccctcgcgccatcagagagtgtcagtaccgacttgcctggcccagtacacctggctccccgctatccccagacagcagactcacctgaggagacggtgaccagggtgccctggccccagtgctggaagtatgtcgacagagtgtcagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccagagtgtcagtaccgactgagcgggctggcaaggc

SEQ ID NO: 1809 - DNA, 495 bp, Artificial Sequence
  Oligonucleotide
gcctccctcgcgccatcagagagtgtcatccatggcttgcctggcccagtacacctggctccccgctatccccagacagcagactcacctgaggagacggtgaccagggtgccctggccccagtgctggaagtatgtcgacagagtgtcatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccagagtgtcatccatggctgagcgggctggcaaggc

SEQ ID NO: 1810 - DNA, 495 bp, Artificial Sequence
  Oligonucleotide
gcctccctcgcgccatcagagagtgtcgtagcagtcttgcctggcccagtacacctggctccccgctatccccagacagcagactcacctgaggagacggtgaccagggtgccctggccccagtgctggaagtatgtcgacagagtgtcgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcagagtgtcgtagcagtctgagcgggctggcaaggc

SEQ ID NO: 1811 - DNA, 495 bp, Artificial Sequence
  Oligonucleotide
gcctccctcgcgccatcagagagtgtcatcttcgtcttgcctggcccagtacacctggctccccgctatccccagacagcagactcacctgaggagacggtgaccagggtgccctggccccagtgctggaagtatgtcgacagagtgtcatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccagagtgtcatcttcgtctgagcgggctggcaaggc

SEQ ID NO: 1812 - DNA, 495 bp, Artificial Sequence
  Oligonucleotide
gcctccctcgcgccatcagagagtgtctccacagtcttgcctggcccagtacacctggctccccgctatccccagacagcagactcacctgaggagacggtgaccagggtgccctggccccagtgctggaagtatgtcgacagagtgtctccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccagagtgtctccacagtctgagcgggctggcaaggc

SEQ ID NO: 1813 - DNA, 495 bp, Artificial Sequence
  Oligonucleotide
gcctccctcgcgccatcagagagtgtcagctagtgcttgcctggcccagtacacctggctccccgctatccccagacagcagactcacctgaggagacggtgaccagggtgccctggccccagtgctggaagtatgtcgacagagtgtcagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccagagtgtcagctagtgctgagcgggctggcaaggc

SEQ ID NO: 1814 - DNA, 495 bp, Artificial Sequence
  Oligonucleotide
gcctccctcgcgccatcagagagtgtctaaccaagcttgcctggcccagtacacctggctccccgctatccccagacagcagactcacctgaggagacggtgaccagggtgccctggccccagtgctggaagtatgtcgacagagtgtctaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccagagtgtctaaccaagctgagcgggctggcaaggc

SEQ ID NO: 1815 - DNA, 495 bp, Artificial Sequence
  Oligonucleotide
gcctccctcgcgccatcagagagtgtccaagaggtcttgcctggcccagtacacctggctccccgctatccccagacagcagactcacctgaggagacggtgaccagggtgccctggccccagtgctggaagtatgtcgacagagtgtccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccagagtgtccaagaggtctgagcgggctggcaaggc

SEQ ID NO: 1816 - DNA, 495 bp, Artificial Sequence
  Oligonucleotide
gcctccctcgcgccatcagagagtgtcagttgacccttgcctggcccagtacacctggctccccgctatccccagacagcagactcacctgaggagacggtgaccagggtgccctggccccagtgctggaagtatgtcgacagagtgtcagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaaagagtgtcagttgaccctgagcgggctggcaaggc

SEQ ID NO: 1817 - DNA, 495 bp, Artificial Sequence
  Oligonucleotide
gcctccctcgcgccatcagagagtgtccagcatatcttgcctggcccagtacacctggctccccgctatccccagacagcagactcacctgaggagacggtgaccagggtgccctggccccagtgctggaagtatgtcgacagagtgtccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaaagagtgtccagcatatctgagcgggctggcaaggc

SEQ ID NO: 1818 - DNA, 495 bp, Artificial Sequence
  Oligonucleotide
gcctccctcgcgccatcagagagtgtcgcaggattcttgcctggcccagtacacctggctccccgctatccccagacagcagactcacctgaggagacggtgaccagggtgccctggccccagtgctggaagtatgtcgacagagtgtcgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataaagagtgtcgcaggattctgagcgggctggcaaggc

SEQ ID NO: 1819 - DNA, 495 bp, Artificial Sequence
  Oligonucleotide
gcctccctcgcgccatcagagagtgtcgtccattccttgcctggcccagtacacctggctccccgctatccccagacagcagactcacctgaggagacggtgaccagggtgccctggccccagtgctggaagtatgtcgacagagtgtcgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccagagtgtcgtccattcctgagcgggctggcaaggc

SEQ ID NO: 1820 - DNA, 495 bp, Artificial Sequence
  Oligonucleotide
gcctccctcgcgccatcagagagtgtcgcataactcttgcctggcccagtacacctggctccccgctatccccagacagcagactcacctgaggagacggtgaccagggtgccctggccccagtgctggaagtatgtcgacagagtgtcgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacagagtgtcgcataactctgagcgggctggcaaggc

SEQ ID NO: 1821 - DNA, 495 bp, Artificial Sequence
  Oligonucleotide
gcctccctcgcgccatcagagagtgtcatatgctgcttgcctggcccagtacacctggctccccgctatccccagacagcagactcacctgaggagacggtgaccagggtgccctggccccagtgctggaagtatgtcgacagagtgtcatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccagagtgtcatatgctgctgagcgggctggcaaggc

SEQ ID NO: 1822 - DNA, 495 bp, Artificial Sequence
  Oligonucleotide
gcctccctcgcgccatcagagagtgtcaatcctgccttgcctggcccagtacacctggctccccgctatccccagacagcagactcacctgaggagacggtgaccagggtgccctggccccagtgctggaagtatgtcgacagagtgtcaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcagagtgtcaatcctgcctgagcgggctggcaaggc

SEQ ID NO: 1823 - DNA, 495 bp, Artificial Sequence
  Oligonucleotide
gcctccctcgcgccatcagagagtgtctgagacctcttgcctggcccagtacacctggctccccgctatccccagacagcagactcacctgaggagacggtgaccagggtgccctggccccagtgctggaagtatgtcgacagagtgtctgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgagagtgtctgagacctctgagcgggctggcaaggc

SEQ ID NO: 1824 - DNA, 495 bp, Artificial Sequence
  Oligonucleotide
gcctccctcgcgccatcagagagtgtcgaatggaccttgcctggcccagtacacctggctccccgctatccccagacagcagactcacctgaggagacggtgaccagggtgccctggccccagtgctggaagtatgtcgacagagtgtcgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccagagtgtcgaatggacctgagcgggctggcaaggc

SEQ ID NO: 1825 - DNA, 495 bp, Artificial Sequence
  Oligonucleotide
gcctccctcgcgccatcagagagtgtccacatggacttgcctggcccagtacacctggctccccgctatccccagacagcagactcacctgaggagacggtgaccagggtgccctggccccagtgctggaagtatgtcgacagagtgtccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccagagtgtccacatggactgagcgggctggcaaggc

SEQ ID NO: 1826 - DNA, 495 bp, Artificial Sequence
  Oligonucleotide
gcctccctcgcgccatcagagagtgtcttgaccatcttgcctggcccagtacacctggctccccgctatccccagacagcagactcacctgaggagacggtgaccagggtgccctggccccagtgctggaagtatgtcgacagagtgtcttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccagagtgtcttgaccatctgagcgggctggcaaggc

SEQ ID NO: 1827 - DNA, 495 bp, Artificial Sequence
  Oligonucleotide
gcctccctcgcgccatcagagagtgtcaagccatccttgcctggcccagtacacctggctccccgctatccccagacagcagactcacctgaggagacggtgaccagggtgccctggccccagtgctggaagtatgtcgacagagtgtcaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccagagtgtcaagccatcctgagcgggctggcaaggc

SEQ ID NO: 1828 - DNA, 495 bp, Artificial Sequence
  Oligonucleotide
gcctccctcgcgccatcagagagtgtctccatgtgcttgcctggcccagtacacctggctccccgctatccccagacagcagactcacctgaggagacggtgaccagggtgccctggccccagtgctggaagtatgtcgacagagtgtctccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccagagtgtctccatgtgctgagcgggctggcaaggc

SEQ ID NO: 1829 - DNA, 495 bp, Artificial Sequence
  Oligonucleotide
gcctccctcgcgccatcagagagtgtccaagtcaccttgcctggcccagtacacctggctccccgctatccccagacagcagactcacctgaggagacggtgaccagggtgccctggccccagtgctggaagtatgtcgacagagtgtccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccagagtgtccaagtcacctgagcgggctggcaaggc

SEQ ID NO: 1830 - DNA, 495 bp, Artificial Sequence
  Oligonucleotide
gcctccctcgcgccatcagagagtgtcctgcaatccttgcctggcccagtacacctggctccccgctatccccagacagcagactcacctgaggagacggtgaccagggtgccctggccccagtgctggaagtatgtcgacagagtgtcctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccagagtgtcctgcaatcctgagcgggctggcaaggc

SEQ ID NO: 1831 - DNA, 495 bp, Artificial Sequence
  Oligonucleotide
gcctccctcgcgccatcagagagtgtcatcgacgacttgcctggcccagtacacctggctccccgctatccccagacagcagactcacctgaggagacggtgaccagggtgccctggccccagtgctggaagtatgtcgacagagtgtcatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccagagtgtcatcgacgactgagcgggctggcaaggc

SEQ ID NO: 1832 - DNA, 495 bp, Artificial Sequence
  Oligonucleotide
gcctccctcgcgccatcagagagtgtcacagactgcttgcctggcccagtacacctggctccccgctatccccagacagcagactcacctgaggagacggtgaccagggtgccctggccccagtgctggaagtatgtcgacagagtgtcacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaaagagtgtcacagactgctgagcgggctggcaaggc

SEQ ID NO: 1833 - DNA, 495 bp, Artificial Sequence
  Oligonucleotide
gcctccctcgcgccatcagagagtgtcccttatagcttgcctggcccagtacacctggctccccgctatccccagacagcagactcacctgaggagacggtgaccagggtgccctggccccagtgctggaagtatgtcgacagagtgtcccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacagagtgtcccttatagctgagcgggctggcaaggc

SEQ ID NO: 1834 - DNA, 495 bp, Artificial Sequence
  Oligonucleotide
gcctccctcgcgccatcagagagtgtctacgcgttcttgcctggcccagtacacctggctccccgctatccccagacagcagactcacctgaggagacggtgaccagggtgccctggccccagtgctggaagtatgtcgacagagtgtctacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccagagtgtctacgcgttctgagcgggctggcaaggc

SEQ ID NO: 1835 - DNA, 495 bp, Artificial Sequence
  Oligonucleotide
gcctccctcgcgccatcagagagtgtcctataaggcttgcctggcccagtacacctggctccccgctatccccagacagcagactcacctgaggagacggtgaccagggtgccctggccccagtgctggaagtatgtcgacagagtgtcctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgagagtgtcctataaggctgagcgggctggcaaggc

SEQ ID NO: 1836 - DNA, 495 bp, Artificial Sequence
  Oligonucleotide
gcctccctcgcgccatcagagagtgtctcttagtccttgcctggcccagtacacctggctccccgctatccccagacagcagactcacctgaggagacggtgaccagggtgccctggccccagtgctggaagtatgtcgacagagtgtctcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcagagtgtctcttagtcctgagcgggctggcaaggc

SEQ ID NO: 1837 - DNA, 495 bp, Artificial Sequence
  Oligonucleotide
gcctccctcgcgccatcagagagtgtctgtctgcacttgcctggcccagtacacctggctccccgctatccccagacagcagactcacctgaggagacggtgaccagggtgccctggccccagtgctggaagtatgtcgacagagtgtctgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccagagtgtctgtctgcactgagcgggctggcaaggc

SEQ ID NO: 1838 - DNA, 495 bp, Artificial Sequence
  Oligonucleotide
gcctccctcgcgccatcagagagtgtcgccattaacttgcctggcccagtacacctggctccccgctatccccagacagcagactcacctgaggagacggtgaccagggtgccctggccccagtgctggaagtatgtcgacagagtgtcgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcagagtgtcgccattaactgagcgggctggcaaggc

SEQ ID NO: 1839 - DNA, 495 bp, Artificial Sequence
  Oligonucleotide
gcctccctcgcgccatcagagagtgtcgactaagacttgcctggcccagtacacctggctccccgctatccccagacagcagactcacctgaggagacggtgaccagggtgccctggccccagtgctggaagtatgtcgacagagtgtcgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgagagtgtcgactaagactgagcgggctggcaaggc

SEQ ID NO: 1840 - DNA, 495 bp, Artificial Sequence
  Oligonucleotide
gcctccctcgcgccatcagagagtgtcaggttgctcttgcctggcccagtacacctggctccccgctatccccagacagcagactcacctgaggagacggtgaccagggtgccctggccccagtgctggaagtatgtcgacagagtgtcaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgagagtgtcaggttgctctgagcgggctggcaaggc

SEQ ID NO: 1841 - DNA, 495 bp, Artificial Sequence
  Oligonucleotide
gcctccctcgcgccatcagagagtgtcctcgagaacttgcctggcccagtacacctggctccccgctatccccagacagcagactcacctgaggagacggtgaccagggtgccctggccccagtgctggaagtatgtcgacagagtgtcctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccagagtgtcctcgagaactgagcgggctggcaaggc

SEQ ID NO: 1842 - DNA, 495 bp, Artificial Sequence
  Oligonucleotide
gcctccctcgcgccatcagagagtgtcttaatggccttgcctggcccagtacacctggctccccgctatccccagacagcagactcacctgaggagacggtgaccagggtgccctggccccagtgctggaagtatgtcgacagagtgtcttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccagagtgtcttaatggcctgagcgggctggcaaggc

SEQ ID NO: 1843 - DNA, 495 bp, Artificial Sequence
  Oligonucleotide
gcctccctcgcgccatcagagagtgtctgcagacacttgcctggcccagtacacctggctccccgctatccccagacagcagactcacctgaggagacggtgaccagggtgccctggccccagtgctggaagtatgtcgacagagtgtctgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaaagagtgtctgcagacactgagcgggctggcaaggc

SEQ ID NO: 1844 - DNA, 495 bp, Artificial Sequence
  Oligonucleotide
gcctccctcgcgccatcagagagtgtctcactgagcttgcctggcccagtacacctggctccccgctatccccagacagcagactcacctgaggagacggtgaccagggtgccctggccccagtgctggaagtatgtcgacagagtgtctcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtagagtgtctcactgagctgagcgggctggcaaggc

SEQ ID NO: 1845 - DNA, 495 bp, Artificial Sequence
  Oligonucleotide
gcctccctcgcgccatcagagagtgtcgagtacgtcttgcctggcccagtacacctggctccccgctatccccagacagcagactcacctgaggagacggtgaccagggtgccctggccccagtgctggaagtatgtcgacagagtgtcgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacagagtgtcgagtacgtctgagcgggctggcaaggc

SEQ ID NO: 1846 - DNA, 495 bp, Artificial Sequence
  Oligonucleotide
gcctccctcgcgccatcagagagtgtcatacgccacttgcctggcccagtacacctggctccccgctatccccagacagcagactcacctgaggagacggtgaccagggtgccctggccccagtgctggaagtatgtcgacagagtgtcatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacagagtgtcatacgccactgagcgggctggcaaggc

SEQ ID NO: 1847 - DNA, 495 bp, Artificial Sequence
  Oligonucleotide
gcctccctcgcgccatcagagagtgtctcgcatcacttgcctggcccagtacacctggctccccgctatccccagacagcagactcacctgaggagacggtgaccagggtgccctggccccagtgctggaagtatgtcgacagagtgtctcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacagagtgtctcgcatcactgagcgggctggcaaggc

SEQ ID NO: 1848 - DNA, 495 bp, Artificial Sequence
  Oligonucleotide
gcctccctcgcgccatcagagagtgtccgcttaatcttgcctggcccagtacacctggctccccgctatccccagacagcagactcacctgaggagacggtgaccagggtgccctggccccagtgctggaagtatgtcgacagagtgtccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacagagtgtccgcttaatctgagcgggctggcaaggc

SEQ ID NO: 1849 - DNA, 495 bp, Artificial Sequence
  Oligonucleotide
gcctccctcgcgccatcagagagtgtctggttatccttgcctggcccagtacacctggctccccgctatccccagacagcagactcacctgaggagacggtgaccagggtgccctggccccagtgctggaagtatgtcgacagagtgtctggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtagagtgtctggttatcctgagcgggctggcaaggc

SEQ ID NO: 1850 - DNA, 495 bp, Artificial Sequence
  Oligonucleotide
gcctccctcgcgccatcagagagtgtcggattgctcttgcctggcccagtacacctggctccccgctatccccagacagcagactcacctgaggagacggtgaccagggtgccctggccccagtgctggaagtatgtcgacagagtgtcggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacagagtgtcggattgctctgagcgggctggcaaggc

SEQ ID NO: 1851 - DNA, 495 bp, Artificial Sequence
  Oligonucleotide
gcctccctcgcgccatcagagagtgtcctcagtgacttgcctggcccagtacacctggctccccgctatccccagacagcagactcacctgaggagacggtgaccagggtgccctggccccagtgctggaagtatgtcgacagagtgtcctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtagagtgtcctcagtgactgagcgggctggcaaggc

SEQ ID NO: 1852 - DNA, 495 bp, Artificial Sequence
  Oligonucleotide
gcctccctcgcgccatcagagagtgtcacgtactccttgcctggcccagtacacctggctccccgctatccccagacagcagactcacctgaggagacggtgaccagggtgccctggccccagtgctggaagtatgtcgacagagtgtcacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacagagtgtcacgtactcctgagcgggctggcaaggc

SEQ ID NO: 1853 - DNA, 495 bp, Artificial Sequence
  Oligonucleotide
gcctccctcgcgccatcagagagtgtctgatgcgacttgcctggcccagtacacctggctccccgctatccccagacagcagactcacctgaggagacggtgaccagggtgccctggccccagtgctggaagtatgtcgacagagtgtctgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccagagtgtctgatgcgactgagcgggctggcaaggc

SEQ ID NO: 1854 - DNA, 495 bp, Artificial Sequence
  Oligonucleotide
gcctccctcgcgccatcagagagtgtcattaagcgcttgcctggcccagtacacctggctccccgctatccccagacagcagactcacctgaggagacggtgaccagggtgccctggccccagtgctggaagtatgtcgacagagtgtcattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccagagtgtcattaagcgctgagcgggctggcaaggc

SEQ ID NO: 1855 - DNA, 495 bp, Artificial Sequence
  Oligonucleotide
gcctccctcgcgccatcagagagtgtcagcaatcccttgcctggcccagtacacctggctccccgctatccccagacagcagactcacctgaggagacggtgaccagggtgccctggccccagtgctggaagtatgtcgacagagtgtcagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccagagtgtcagcaatccctgagcgggctggcaaggc

SEQ ID NO: 1856 - DNA, 495 bp, Artificial Sequence
  Oligonucleotide
gcctccctcgcgccatcagagagtgtcgcttagtacttgcctggcccagtacacctggctccccgctatccccagacagcagactcacctgaggagacggtgaccagggtgccctggccccagtgctggaagtatgtcgacagagtgtcgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgaagagtgtcgcttagtactgagcgggctggcaaggc

SEQ ID NO: 1857 - DNA, 495 bp, Artificial Sequence
  Oligonucleotide
gcctccctcgcgccatcagagagtgtctgaccttgcttgcctggcccagtacacctggctccccgctatccccagacagcagactcacctgaggagacggtgaccagggtgccctggccccagtgctggaagtatgtcgacagagtgtctgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccagagtgtctgaccttgctgagcgggctggcaaggc

SEQ ID NO: 1858 - DNA, 495 bp, Artificial Sequence
  Oligonucleotide
gcctccctcgcgccatcagagagtgtccaaggtcacttgcctggcccagtacacctggctccccgctatccccagacagcagactcacctgaggagacggtgaccagggtgccctggccccagtgctggaagtatgtcgacagagtgtccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccagagtgtccaaggtcactgagcgggctggcaaggc

SEQ ID NO: 1859 - DNA, 495 bp, Artificial Sequence
  Oligonucleotide
gcctccctcgcgccatcagagagtgtccactgtaccttgcctggcccagtacacctggctccccgctatccccagacagcagactcacctgaggagacggtgaccagggtgccctggccccagtgctggaagtatgtcgacagagtgtccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcagagtgtccactgtacctgagcgggctggcaaggc

SEQ ID NO: 1860 - DNA, 495 bp, Artificial Sequence
  Oligonucleotide
gcctccctcgcgccatcagagagtgtcgatgatcccttgcctggcccagtacacctggctccccgctatccccagacagcagactcacctgaggagacggtgaccagggtgccctggccccagtgctggaagtatgtcgacagagtgtcgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggagagtgtcgatgatccctgagcgggctggcaaggc

SEQ ID NO: 1861 - DNA, 495 bp, Artificial Sequence
  Oligonucleotide
gcctccctcgcgccatcagagagtgtccgccaatacttgcctggcccagtacacctggctccccgctatccccagacagcagactcacctgaggagacggtgaccagggtgccctggccccagtgctggaagtatgtcgacagagtgtccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggagagtgtccgccaatactgagcgggctggcaaggc

SEQ ID NO: 1862 - DNA, 495 bp, Artificial Sequence
  Oligonucleotide
gcctccctcgcgccatcagagagtgtctcaagcctcttgcctggcccagtacacctggctccccgctatccccagacagcagactcacctgaggagacggtgaccagggtgccctggccccagtgctggaagtatgtcgacagagtgtctcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacaagagtgtctcaagcctctgagcgggctggcaaggc

SEQ ID NO: 1863 - DNA, 495 bp, Artificial Sequence
  Oligonucleotide
gcctccctcgcgccatcagagagtgtcacgtgtgtcttgcctggcccagtacacctggctccccgctatccccagacagcagactcacctgaggagacggtgaccagggtgccctggccccagtgctggaagtatgtcgacagagtgtcacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagagagtgtcacgtgtgtctgagcgggctggcaaggc

SEQ ID NO: 1864 - DNA, 495 bp, Artificial Sequence
  Oligonucleotide
gcctccctcgcgccatcagagagtgtctccgtctacttgcctggcccagtacacctggctccccgctatccccagacagcagactcacctgaggagacggtgaccagggtgccctggccccagtgctggaagtatgtcgacagagtgtctccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagagagtgtctccgtctactgagcgggctggcaaggc

SEQ ID NO: 1865 - DNA, 495 bp, Artificial Sequence
  Oligonucleotide
gcctccctcgcgccatcagagagtgtcaagagctgcttgcctggcccagtacacctggctccccgctatccccagacagcagactcacctgaggagacggtgaccagggtgccctggccccagtgctggaagtatgtcgacagagtgtcaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgagagtgtcaagagctgctgagcgggctggcaaggc

SEQ ID NO: 1866 - DNA, 495 bp, Artificial Sequence
  Oligonucleotide
gcctccctcgcgccatcagagagtgtctatcgctccttgcctggcccagtacacctggctccccgctatccccagacagcagactcacctgaggagacggtgaccagggtgccctggccccagtgctggaagtatgtcgacagagtgtctatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagagagtgtctatcgctcctgagcgggctggcaaggc

SEQ ID NO: 1867 - DNA, 495 bp, Artificial Sequence
  Oligonucleotide
gcctccctcgcgccatcagagagtgtctcagatgccttgcctggcccagtacacctggctccccgctatccccagacagcagactcacctgaggagacggtgaccagggtgccctggccccagtgctggaagtatgtcgacagagtgtctcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccagagtgtctcagatgcctgagcgggctggcaaggc

SEQ ID NO: 1868 - DNA, 495 bp, Artificial Sequence
  Oligonucleotide
gcctccctcgcgccatcagagagtgtcgtgtagcacttgcctggcccagtacacctggctccccgctatccccagacagcagactcacctgaggagacggtgaccagggtgccctggccccagtgctggaagtatgtcgacagagtgtcgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgagagtgtcgtgtagcactgagcgggctggcaaggc

SEQ ID NO: 1869 - DNA, 495 bp, Artificial Sequence
  Oligonucleotide
gcctccctcgcgccatcagagagtgtctggcagttcttgcctggcccagtacacctggctccccgctatccccagacagcagactcacctgaggagacggtgaccagggtgccctggccccagtgctggaagtatgtcgacagagtgtctggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgagagtgtctggcagttctgagcgggctggcaaggc

SEQ ID NO: 1870 - DNA, 495 bp, Artificial Sequence
  Oligonucleotide
gcctccctcgcgccatcagagagtgtccagtccaacttgcctggcccagtacacctggctccccgctatccccagacagcagactcacctgaggagacggtgaccagggtgccctggccccagtgctggaagtatgtcgacagagtgtccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacagagtgtccagtccaactgagcgggctggcaaggc

SEQ ID NO: 1871 - DNA, 495 bp, Artificial Sequence
  Oligonucleotide
gcctccctcgcgccatcagagagtgtcgtgtctaccttgcctggcccagtacacctggctccccgctatccccagacagcagactcacctgaggagacggtgaccagggtgccctggccccagtgctggaagtatgtcgacagagtgtcgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggagagtgtcgtgtctacctgagcgggctggcaaggc

SEQ ID NO: 1872 - DNA, 495 bp, Artificial Sequence
  Oligonucleotide
gcctccctcgcgccatcagagagtgtcgtacagtgcttgcctggcccagtacacctggctccccgctatccccagacagcagactcacctgaggagacggtgaccagggtgccctggccccagtgctggaagtatgtcgacagagtgtcgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagagagtgtcgtacagtgctgagcgggctggcaaggc

SEQ ID NO: 1873 - DNA, 495 bp, Artificial Sequence
  Oligonucleotide
gcctccctcgcgccatcagagagtgtcggatcatccttgcctggcccagtacacctggctccccgctatccccagacagcagactcacctgaggagacggtgaccagggtgccctggccccagtgctggaagtatgtcgacagagtgtcggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagagagtgtcggatcatcctgagcgggctggcaaggc

SEQ ID NO: 1874 - DNA, 495 bp, Artificial Sequence
  Oligonucleotide
gcctccctcgcgccatcagagagtgtctattggcgcttgcctggcccagtacacctggctccccgctatccccagacagcagactcacctgaggagacggtgaccagggtgccctggccccagtgctggaagtatgtcgacagagtgtctattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcaagagtgtctattggcgctgagcgggctggcaaggc

SEQ ID NO: 1875 - DNA, 495 bp, Artificial Sequence
  Oligonucleotide
gcctccctcgcgccatcagagagtgtcaggcttgacttgcctggcccagtacacctggctccccgctatccccagacagcagactcacctgaggagacggtgaccagggtgccctggccccagtgctggaagtatgtcgacagagtgtcaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacagagtgtcaggcttgactgagcgggctggcaaggc

SEQ ID NO: 1876 - DNA, 495 bp, Artificial Sequence
  Oligonucleotide
gcctccctcgcgccatcagagagtgtcacacacgtcttgcctggcccagtacacctggctccccgctatccccagacagcagactcacctgaggagacggtgaccagggtgccctggccccagtgctggaagtatgtcgacagagtgtcacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatagagtgtcacacacgtctgagcgggctggcaaggc

SEQ ID NO: 1877 - DNA, 495 bp, Artificial Sequence
  Oligonucleotide
gcctccctcgcgccatcagagagtgtctagacggacttgcctggcccagtacacctggctccccgctatccccagacagcagactcacctgaggagacggtgaccagggtgccctggccccagtgctggaagtatgtcgacagagtgtctagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaagagtgtctagacggactgagcgggctggcaaggc

SEQ ID NO: 1878 - DNA, 495 bp, Artificial Sequence
  Oligonucleotide
gcctccctcgcgccatcagagagtgtcgagcgatacttgcctggcccagtacacctggctccccgctatccccagacagcagactcacctgaggagacggtgaccagggtgccctggccccagtgctggaagtatgtcgacagagtgtcgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttagagtgtcgagcgatactgagcgggctggcaaggc

SEQ ID NO: 1879 - DNA, 495 bp, Artificial Sequence
  Oligonucleotide
gcctccctcgcgccatcagagagtgtcgcatctgacttgcctggcccagtacacctggctccccgctatccccagacagcagactcacctgaggagacggtgaccagggtgccctggccccagtgctggaagtatgtcgacagagtgtcgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacaagagtgtcgcatctgactgagcgggctggcaaggc

SEQ ID NO: 1880 - DNA, 495 bp, Artificial Sequence
  Oligonucleotide
gcctccctcgcgccatcagagagtgtctgctacaccttgcctggcccagtacacctggctccccgctatccccagacagcagactcacctgaggagacggtgaccagggtgccctggccccagtgctggaagtatgtcgacagagtgtctgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgagagtgtctgctacacctgagcgggctggcaaggc

SEQ ID NO: 1881 - DNA, 495 bp, Artificial Sequence
  Oligonucleotide
gcctccctcgcgccatcagagagtgtcaactgccacttgcctggcccagtacacctggctccccgctatccccagacagcagactcacctgaggagacggtgaccagggtgccctggccccagtgctggaagtatgtcgacagagtgtcaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttagagtgtcaactgccactgagcgggctggcaaggc

SEQ ID NO: 1882 - DNA, 495 bp, Artificial Sequence
  Oligonucleotide
gcctccctcgcgccatcagagagtgtcttggactgcttgcctggcccagtacacctggctccccgctatccccagacagcagactcacctgaggagacggtgaccagggtgccctggccccagtgctggaagtatgtcgacagagtgtcttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggagagtgtcttggactgctgagcgggctggcaaggc

SEQ ID NO: 1883 - DNA, 495 bp, Artificial Sequence
  Oligonucleotide
gcctccctcgcgccatcagagagtgtctcggtactcttgcctggcccagtacacctggctccccgctatccccagacagcagactcacctgaggagacggtgaccagggtgccctggccccagtgctggaagtatgtcgacagagtgtctcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgagagtgtctcggtactctgagcgggctggcaaggc

SEQ ID NO: 1884 - DNA, 495 bp, Artificial Sequence
  Oligonucleotide
gcctccctcgcgccatcagagagtgtcccatggatcttgcctggcccagtacacctggctccccgctatccccagacagcagactcacctgaggagacggtgaccagggtgccctggccccagtgctggaagtatgtcgacagagtgtcccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacagagtgtcccatggatctgagcgggctggcaaggc

SEQ ID NO: 1885 - DNA, 495 bp, Artificial Sequence
  Oligonucleotide
gcctccctcgcgccatcagagagtgtcacgaagatcttgcctggcccagtacacctggctccccgctatccccagacagcagactcacctgaggagacggtgaccagggtgccctggccccagtgctggaagtatgtcgacagagtgtcacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaaagagtgtcacgaagatctgagcgggctggcaaggc

SEQ ID NO: 1886 - DNA, 495 bp, Artificial Sequence
  Oligonucleotide
gcctccctcgcgccatcagagagtgtcactgtggacttgcctggcccagtacacctggctccccgctatccccagacagcagactcacctgaggagacggtgaccagggtgccctggccccagtgctggaagtatgtcgacagagtgtcactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttagagtgtcactgtggactgagcgggctggcaaggc

SEQ ID NO: 1887 - DNA, 495 bp, Artificial Sequence
  Oligonucleotide
gcctccctcgcgccatcagagagtgtcggtgtcatcttgcctggcccagtacacctggctccccgctatccccagacagcagactcacctgaggagacggtgaccagggtgccctggccccagtgctggaagtatgtcgacagagtgtcggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctagagtgtcggtgtcatctgagcgggctggcaaggc

SEQ ID NO: 1888 - DNA, 495 bp, Artificial Sequence
  Oligonucleotide
gcctccctcgcgccatcagagagtgtctcgtgaagcttgcctggcccagtacacctggctccccgctatccccagacagcagactcacctgaggagacggtgaccagggtgccctggccccagtgctggaagtatgtcgacagagtgtctcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggagagtgtctcgtgaagctgagcgggctggcaaggc

SEQ ID NO: 1889 - DNA, 495 bp, Artificial Sequence
  Oligonucleotide
gcctccctcgcgccatcagagagtgtccactagctcttgcctggcccagtacacctggctccccgctatccccagacagcagactcacctgaggagacggtgaccagggtgccctggccccagtgctggaagtatgtcgacagagtgtccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaaagagtgtccactagctctgagcgggctggcaaggc

SEQ ID NO: 1890 - DNA, 495 bp, Artificial Sequence
  Oligonucleotide
gcctccctcgcgccatcagagagtgtcggtcaactcttgcctggcccagtacacctggctccccgctatccccagacagcagactcacctgaggagacggtgaccagggtgccctggccccagtgctggaagtatgtcgacagagtgtcggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggaagagtgtcggtcaactctgagcgggctggcaaggc

SEQ ID NO: 1891 - DNA, 495 bp, Artificial Sequence
  Oligonucleotide
gcctccctcgcgccatcagagagtgtctacgtacgcttgcctggcccagtacacctggctccccgctatccccagacagcagactcacctgaggagacggtgaccagggtgccctggccccagtgctggaagtatgtcgacagagtgtctacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcagagtgtctacgtacgctgagcgggctggcaaggc

SEQ ID NO: 1892 - DNA, 495 bp, Artificial Sequence
  Oligonucleotide
gcctccctcgcgccatcagagagtgtcatgacacccttgcctggcccagtacacctggctccccgctatccccagacagcagactcacctgaggagacggtgaccagggtgccctggccccagtgctggaagtatgtcgacagagtgtcatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggagagtgtcatgacaccctgagcgggctggcaaggc

SEQ ID NO: 1893 - DNA, 495 bp, Artificial Sequence
  Oligonucleotide
gcctccctcgcgccatcagagagtgtccttcacgacttgcctggcccagtacacctggctccccgctatccccagacagcagactcacctgaggagacggtgaccagggtgccctggccccagtgctggaagtatgtcgacagagtgtccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacagagtgtccttcacgactgagcgggctggcaaggc

SEQ ID NO: 1894 - DNA, 495 bp, Artificial Sequence
  Oligonucleotide
gcctccctcgcgccatcagagagtgtcagaatcagcttgcctggcccagtacacctggctccccgctatccccagacagcagactcacctgaggagacggtgaccagggtgccctggccccagtgctggaagtatgtcgacagagtgtcagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccagagtgtcagaatcagctgagcgggctggcaaggc

SEQ ID NO: 1895 - DNA, 495 bp, Artificial Sequence
  Oligonucleotide
gcctccctcgcgccatcagagagtgtcagttatgccttgcctggcccagtacacctggctccccgctatccccagacagcagactcacctgaggagacggtgaccagggtgccctggccccagtgctggaagtatgtcgacagagtgtcagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataaagagtgtcagttatgcctgagcgggctggcaaggc

SEQ ID NO: 1896 - DNA, 495 bp, Artificial Sequence
  Oligonucleotide
gcctccctcgcgccatcagagagtgtcaggtctcacttgcctggcccagtacacctggctccccgctatccccagacagcagactcacctgaggagacggtgaccagggtgccctggccccagtgctggaagtatgtcgacagagtgtcaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccagagtgtcaggtctcactgagcgggctggcaaggc

SEQ ID NO: 1897 - DNA, 495 bp, Artificial Sequence
  Oligonucleotide
gcctccctcgcgccatcagagagtgtcgtcatagtcttgcctggcccagtacacctggctccccgctatccccagacagcagactcacctgaggagacggtgaccagggtgccctggccccagtgctggaagtatgtcgacagagtgtcgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtagagtgtcgtcatagtctgagcgggctggcaaggc

SEQ ID NO: 1898 - DNA, 495 bp, Artificial Sequence
  Oligonucleotide
gcctccctcgcgccatcagagagtgtcgtgacttgcttgcctggcccagtacacctggctccccgctatccccagacagcagactcacctgaggagacggtgaccagggtgccctggccccagtgctggaagtatgtcgacagagtgtcgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgagagtgtcgtgacttgctgagcgggctggcaaggc

SEQ ID NO: 1899 - DNA, 495 bp, Artificial Sequence
  Oligonucleotide
gcctccctcgcgccatcagagagtgtcgattgcagcttgcctggcccagtacacctggctccccgctatccccagacagcagactcacctgaggagacggtgaccagggtgccctggccccagtgctggaagtatgtcgacagagtgtcgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccagagtgtcgattgcagctgagcgggctggcaaggc

SEQ ID NO: 1900 - DNA, 495 bp, Artificial Sequence
  Oligonucleotide
gcctccctcgcgccatcagagagtgtcactatgaccttgcctggcccagtacacctggctccccgctatccccagacagcagactcacctgaggagacggtgaccagggtgccctggccccagtgctggaagtatgtcgacagagtgtcactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacagagtgtcactatgacctgagcgggctggcaaggc

SEQ ID NO: 1901 - DNA, 495 bp, Artificial Sequence
  Oligonucleotide
gcctccctcgcgccatcagagagtgtcatggtcaacttgcctggcccagtacacctggctccccgctatccccagacagcagactcacctgaggagacggtgaccagggtgccctggccccagtgctggaagtatgtcgacagagtgtcatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacagagtgtcatggtcaactgagcgggctggcaaggc

SEQ ID NO: 1902 - DNA, 495 bp, Artificial Sequence
  Oligonucleotide
gcctccctcgcgccatcagagagtgtcgatggcttcttgcctggcccagtacacctggctccccgctatccccagacagcagactcacctgaggagacggtgaccagggtgccctggccccagtgctggaagtatgtcgacagagtgtcgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacagagtgtcgatggcttctgagcgggctggcaaggc

SEQ ID NO: 1903 - DNA, 495 bp, Artificial Sequence
  Oligonucleotide
gcctccctcgcgccatcagagagtgtcagcatatgcttgcctggcccagtacacctggctccccgctatccccagacagcagactcacctgaggagacggtgaccagggtgccctggccccagtgctggaagtatgtcgacagagtgtcagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacagagtgtcagcatatgctgagcgggctggcaaggc

SEQ ID NO: 1904 - DNA, 495 bp, Artificial Sequence
  Oligonucleotide
gcctccctcgcgccatcagagagtgtccatatgctcttgcctggcccagtacacctggctccccgctatccccagacagcagactcacctgaggagacggtgaccagggtgccctggccccagtgctggaagtatgtcgacagagtgtccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgagagtgtccatatgctctgagcgggctggcaaggc

SEQ ID NO: 1905 - DNA, 495 bp, Artificial Sequence
  Oligonucleotide
gcctccctcgcgccatcagagagtgtctcgtcgatcttgcctggcccagtacacctggctccccgctatccccagacagcagactcacctgaggagacggtgaccagggtgccctggccccagtgctggaagtatgtcgacagagtgtctcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccagagtgtctcgtcgatctgagcgggctggcaaggc

SEQ ID NO: 1906 - DNA, 495 bp, Artificial Sequence
  Oligonucleotide
gcctccctcgcgccatcagagagtgtccagtctgtcttgcctggcccagtacacctggctccccgctatccccagacagcagactcacctgaggagacggtgaccagggtgccctggccccagtgctggaagtatgtcgacagagtgtccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcagagtgtccagtctgtctgagcgggctggcaaggc

SEQ ID NO: 1907 - DNA, 495 bp, Artificial Sequence
  Oligonucleotide
gcctccctcgcgccatcagagagtgtcaacgcgtacttgcctggcccagtacacctggctccccgctatccccagacagcagactcacctgaggagacggtgaccagggtgccctggccccagtgctggaagtatgtcgacagagtgtcaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgagagtgtcaacgcgtactgagcgggctggcaaggc

SEQ ID NO: 1908 - DNA, 495 bp, Artificial Sequence
  Oligonucleotide
gcctccctcgcgccatcagagagtgtcgtagttcgcttgcctggcccagtacacctggctccccgctatccccagacagcagactcacctgaggagacggtgaccagggtgccctggccccagtgctggaagtatgtcgacagagtgtcgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcagagtgtcgtagttcgctgagcgggctggcaaggc

SEQ ID NO: 1909 - DNA, 495 bp, Artificial Sequence
  Oligonucleotide
gcctccctcgcgccatcagagagtgtccgaactaccttgcctggcccagtacacctggctccccgctatccccagacagcagactcacctgaggagacggtgaccagggtgccctggccccagtgctggaagtatgtcgacagagtgtccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacagagtgtccgaactacctgagcgggctggcaaggc

SEQ ID NO: 1910 - DNA, 495 bp, Artificial Sequence
  Oligonucleotide
gcctccctcgcgccatcagagagtgtcttaacgtccttgcctggcccagtacacctggctccccgctatccccagacagcagactcacctgaggagacggtgaccagggtgccctggccccagtgctggaagtatgtcgacagagtgtcttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccagagtgtcttaacgtcctgagcgggctggcaaggc

SEQ ID NO: 1911 - DNA, 495 bp, Artificial Sequence
  Oligonucleotide
gcctccctcgcgccatcagagagtgtcagcaacctcttgcctggcccagtacacctggctccccgctatccccagacagcagactcacctgaggagacggtgaccagggtgccctggccccagtgctggaagtatgtcgacagagtgtcagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacagagtgtcagcaacctctgagcgggctggcaaggc

SEQ ID NO: 1912 - DNA, 495 bp, Artificial Sequence
  Oligonucleotide
gcctccctcgcgccatcagagagtgtcttctcgagcttgcctggcccagtacacctggctccccgctatccccagacagcagactcacctgaggagacggtgaccagggtgccctggccccagtgctggaagtatgtcgacagagtgtcttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttagagtgtcttctcgagctgagcgggctggcaaggc

SEQ ID NO: 1913 - DNA, 495 bp, Artificial Sequence
  Oligonucleotide
gcctccctcgcgccatcagagagtgtcactctacgcttgcctggcccagtacacctggctccccgctatccccagacagcagactcacctgaggagacggtgaccagggtgccctggccccagtgctggaagtatgtcgacagagtgtcactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacagagtgtcactctacgctgagcgggctggcaaggc

SEQ ID NO: 1914 - DNA, 495 bp, Artificial Sequence
  Oligonucleotide
gcctccctcgcgccatcagagagtgtctaccggaacttgcctggcccagtacacctggctccccgctatccccagacagcagactcacctgaggagacggtgaccagggtgccctggccccagtgctggaagtatgtcgacagagtgtctaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccagagtgtctaccggaactgagcgggctggcaaggc

SEQ ID NO: 1915 - DNA, 495 bp, Artificial Sequence
  Oligonucleotide
gcctccctcgcgccatcagagagtgtccgaattgccttgcctggcccagtacacctggctccccgctatccccagacagcagactcacctgaggagacggtgaccagggtgccctggccccagtgctggaagtatgtcgacagagtgtccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacagagtgtccgaattgcctgagcgggctggcaaggc

SEQ ID NO: 1916 - DNA, 495 bp, Artificial Sequence
  Oligonucleotide
gcctccctcgcgccatcagagagtgtcttcgctcacttgcctggcccagtacacctggctccccgctatccccagacagcagactcacctgaggagacggtgaccagggtgccctggccccagtgctggaagtatgtcgacagagtgtcttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacaagagtgtcttcgctcactgagcgggctggcaaggc

SEQ ID NO: 1917 - DNA, 495 bp, Artificial Sequence
  Oligonucleotide
gcctccctcgcgccatcagagagtgtcgacgttaacttgcctggcccagtacacctggctccccgctatccccagacagcagactcacctgaggagacggtgaccagggtgccctggccccagtgctggaagtatgtcgacagagtgtcgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgagagtgtcgacgttaactgagcgggctggcaaggc

SEQ ID NO: 1918 - DNA, 495 bp, Artificial Sequence
  Oligonucleotide
gcctccctcgcgccatcagagagtgtccgtagagtcttgcctggcccagtacacctggctccccgctatccccagacagcagactcacctgaggagacggtgaccagggtgccctggccccagtgctggaagtatgtcgacagagtgtccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcagagtgtccgtagagtctgagcgggctggcaaggc

SEQ ID NO: 1919 - DNA, 495 bp, Artificial Sequence
  Oligonucleotide
gcctccctcgcgccatcagagagtgtcttccggtacttgcctggcccagtacacctggctccccgctatccccagacagcagactcacctgaggagacggtgaccagggtgccctggccccagtgctggaagtatgtcgacagagtgtcttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcagagtgtcttccggtactgagcgggctggcaaggc

SEQ ID NO: 1920 - DNA, 495 bp, Artificial Sequence
  Oligonucleotide
gcctccctcgcgccatcagagagtgtcgcaattcgcttgcctggcccagtacacctggctccccgctatccccagacagcagactcacctgaggagacggtgaccagggtgccctggccccagtgctggaagtatgtcgacagagtgtcgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacagagtgtcgcaattcgctgagcgggctggcaaggc

SEQ ID NO: 1921 - DNA, 495 bp, Artificial Sequence
  Oligonucleotide
gcctccctcgcgccatcagagagtgtctgagcgaacttgcctggcccagtacacctggctccccgctatccccagacagcagactcacctgaggagacggtgaccagggtgccctggccccagtgctggaagtatgtcgacagagtgtctgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcagagtgtctgagcgaactgagcgggctggcaaggc

SEQ ID NO: 1922 - DNA, 495 bp, Artificial Sequence
  Oligonucleotide
gcctccctcgcgccatcagagagtgtctactaagccttgcctggcccagtacacctggctccccgctatccccagacagcagactcacctgaggagacggtgaccagggtgccctggccccagtgctggaagtatgtcgacagagtgtctactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccagagtgtctactaagcctgagcgggctggcaaggc

SEQ ID NO: 1923 - DNA, 495 bp, Artificial Sequence
  Oligonucleotide
gcctccctcgcgccatcagagagtgtctggcgtatcttgcctggcccagtacacctggctccccgctatccccagacagcagactcacctgaggagacggtgaccagggtgccctggccccagtgctggaagtatgtcgacagagtgtctggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtagagtgtctggcgtatctgagcgggctggcaaggc

SEQ ID NO: 1924 - DNA, 495 bp, Artificial Sequence
  Oligonucleotide
gcctccctcgcgccatcagagagtgtcgataaccacttgcctggcccagtacacctggctccccgctatccccagacagcagactcacctgaggagacggtgaccagggtgccctggccccagtgctggaagtatgtcgacagagtgtcgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgagagtgtcgataaccactgagcgggctggcaaggc

SEQ ID NO: 1925 - DNA, 495 bp, Artificial Sequence
  Oligonucleotide
gcctccctcgcgccatcagagagtgtcctagtgaacttgcctggcccagtacacctggctccccgctatccccagacagcagactcacctgaggagacggtgaccagggtgccctggccccagtgctggaagtatgtcgacagagtgtcctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagagagtgtcctagtgaactgagcgggctggcaaggc

SEQ ID NO: 1926 - DNA, 495 bp, Artificial Sequence
  Oligonucleotide
gcctccctcgcgccatcagagagtgtcacgttcaccttgcctggcccagtacacctggctccccgctatccccagacagcagactcacctgaggagacggtgaccagggtgccctggccccagtgctggaagtatgtcgacagagtgtcacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtagagtgtcacgttcacctgagcgggctggcaaggc

SEQ ID NO: 1927 - DNA, 448 bp, Artificial Sequence
  Oligonucleotide
gcctccctcgcgccatcagagagtgtcattacgctcttgcctggcccagtacacctggctccccgctatccccagacagcagactcacctgaggagacggtgaccagggtgccctggccccagtgctggaagtatgtcgacagagtgtcattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcaagagtgtcattacgctctgagcgggctggcaaggc

SEQ ID NO: 1928 - DNA, 495 bp, Artificial Sequence
  Oligonucleotide
gcctccctcgcgccatcagagagtgtccattgagtcttgcctggcccagtacacctggctccccgctatccccagacagcagactcacctgaggagacggtgaccagggtgccctggccccagtgctggaagtatgtcgacagagtgtccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccagagtgtccattgagtctgagcgggctggcaaggc

SEQ ID NO: 1929 - DNA, 495 bp, Artificial Sequence
  Oligonucleotide
gcctccctcgcgccatcaggttccgaacttggttatggcctggtgcctggacagagaagactgggagggggctgcagtgggactcacctgaggagacagtgaccagggtgccacggccccagagatcgaagtaccgtcgacgttccgaacttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgttccgaacttggttactgagcgggctggcaaggc

SEQ ID NO: 1930 - DNA, 495 bp, Artificial Sequence
  Oligonucleotide
gcctccctcgcgccatcaggttccgaaacctcttgtggcctggtgcctggacagagaagactgggagggggctgcagtgggactcacctgaggagacagtgaccagggtgccacggccccagagatcgaagtaccgtcgacgttccgaaacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgttccgaaacctcttgctgagcgggctggcaaggc

SEQ ID NO: 1931 - DNA, 495 bp, Artificial Sequence
  Oligonucleotide
gcctccctcgcgccatcaggttccgaactgattcttggcctggtgcctggacagagaagactgggagggggctgcagtgggactcacctgaggagacagtgaccagggtgccacggccccagagatcgaagtaccgtcgacgttccgaactgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgttccgaactgattctctgagcgggctggcaaggc

SEQ ID NO: 1932 - DNA, 495 bp, Artificial Sequence
  Oligonucleotide
gcctccctcgcgccatcaggttccgaaagtaccgatggcctggtgcctggacagagaagactgggagggggctgcagtgggactcacctgaggagacagtgaccagggtgccacggccccagagatcgaagtaccgtcgacgttccgaaagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgttccgaaagtaccgactgagcgggctggcaaggc

SEQ ID NO: 1933 - DNA, 495 bp, Artificial Sequence
  Oligonucleotide
gcctccctcgcgccatcaggttccgaaatccatggtggcctggtgcctggacagagaagactgggagggggctgcagtgggactcacctgaggagacagtgaccagggtgccacggccccagagatcgaagtaccgtcgacgttccgaaatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgttccgaaatccatggctgagcgggctggcaaggc

SEQ ID NO: 1934 - DNA, 495 bp, Artificial Sequence
  Oligonucleotide
gcctccctcgcgccatcaggttccgaagtagcagttggcctggtgcctggacagagaagactgggagggggctgcagtgggactcacctgaggagacagtgaccagggtgccacggccccagagatcgaagtaccgtcgacgttccgaagtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgttccgaagtagcagtctgagcgggctggcaaggc

SEQ ID NO: 1935 - DNA, 495 bp, Artificial Sequence
  Oligonucleotide
gcctccctcgcgccatcaggttccgaaatcttcgttggcctggtgcctggacagagaagactgggagggggctgcagtgggactcacctgaggagacagtgaccagggtgccacggccccagagatcgaagtaccgtcgacgttccgaaatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgttccgaaatcttcgtctgagcgggctggcaaggc

SEQ ID NO: 1936 - DNA, 495 bp, Artificial Sequence
  Oligonucleotide
gcctccctcgcgccatcaggttccgaatccacagttggcctggtgcctggacagagaagactgggagggggctgcagtgggactcacctgaggagacagtgaccagggtgccacggccccagagatcgaagtaccgtcgacgttccgaatccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgttccgaatccacagtctgagcgggctggcaaggc

SEQ ID NO: 1937 - DNA, 495 bp, Artificial Sequence
  Oligonucleotide
gcctccctcgcgccatcaggttccgaaagctagtgtggcctggtgcctggacagagaagactgggagggggctgcagtgggactcacctgaggagacagtgaccagggtgccacggccccagagatcgaagtaccgtcgacgttccgaaagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgttccgaaagctagtgctgagcgggctggcaaggc

SEQ ID NO: 1938 - DNA, 495 bp, Artificial Sequence
  Oligonucleotide
gcctccctcgcgccatcaggttccgaataaccaagtggcctggtgcctggacagagaagactgggagggggctgcagtgggactcacctgaggagacagtgaccagggtgccacggccccagagatcgaagtaccgtcgacgttccgaataaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgttccgaataaccaagctgagcgggctggcaaggc

SEQ ID NO: 1939 - DNA, 495 bp, Artificial Sequence
  Oligonucleotide
gcctccctcgcgccatcaggttccgaacaagaggttggcctggtgcctggacagagaagactgggagggggctgcagtgggactcacctgaggagacagtgaccagggtgccacggccccagagatcgaagtaccgtcgacgttccgaacaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgttccgaacaagaggtctgagcgggctggcaaggc

SEQ ID NO: 1940 - DNA, 495 bp, Artificial Sequence
  Oligonucleotide
gcctccctcgcgccatcaggttccgaaagttgacctggcctggtgcctggacagagaagactgggagggggctgcagtgggactcacctgaggagacagtgaccagggtgccacggccccagagatcgaagtaccgtcgacgttccgaaagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagttccgaaagttgaccctgagcgggctggcaaggc

SEQ ID NO: 1941 - DNA, 495 bp, Artificial Sequence
  Oligonucleotide
gcctccctcgcgccatcaggttccgaacagcatattggcctggtgcctggacagagaagactgggagggggctgcagtgggactcacctgaggagacagtgaccagggtgccacggccccagagatcgaagtaccgtcgacgttccgaacagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagttccgaacagcatatctgagcgggctggcaaggc

SEQ ID NO: 1942 - DNA, 495 bp, Artificial Sequence
  Oligonucleotide
gcctccctcgcgccatcaggttccgaagcaggatttggcctggtgcctggacagagaagactgggagggggctgcagtgggactcacctgaggagacagtgaccagggtgccacggccccagagatcgaagtaccgtcgacgttccgaagcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagttccgaagcaggattctgagcgggctggcaaggc

SEQ ID NO: 1943 - DNA, 495 bp, Artificial Sequence
  Oligonucleotide
gcctccctcgcgccatcaggttccgaagtccattctggcctggtgcctggacagagaagactgggagggggctgcagtgggactcacctgaggagacagtgaccagggtgccacggccccagagatcgaagtaccgtcgacgttccgaagtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgttccgaagtccattcctgagcgggctggcaaggc

SEQ ID NO: 1944 - DNA, 495 bp, Artificial Sequence
  Oligonucleotide
gcctccctcgcgccatcaggttccgaagcataacttggcctggtgcctggacagagaagactgggagggggctgcagtgggactcacctgaggagacagtgaccagggtgccacggccccagagatcgaagtaccgtcgacgttccgaagcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgttccgaagcataactctgagcgggctggcaaggc

SEQ ID NO: 1945 - DNA, 495 bp, Artificial Sequence
  Oligonucleotide
gcctccctcgcgccatcaggttccgaaatatgctgtggcctggtgcctggacagagaagactgggagggggctgcagtgggactcacctgaggagacagtgaccagggtgccacggccccagagatcgaagtaccgtcgacgttccgaaatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgttccgaaatatgctgctgagcgggctggcaaggc

SEQ ID NO: 1946 - DNA, 495 bp, Artificial Sequence
  Oligonucleotide
gcctccctcgcgccatcaggttccgaaaatcctgctggcctggtgcctggacagagaagactgggagggggctgcagtgggactcacctgaggagacagtgaccagggtgccacggccccagagatcgaagtaccgtcgacgttccgaaaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgttccgaaaatcctgcctgagcgggctggcaaggc

SEQ ID NO: 1947 - DNA, 495 bp, Artificial Sequence
  Oligonucleotide
gcctccctcgcgccatcaggttccgaatgagaccttggcctggtgcctggacagagaagactgggagggggctgcagtgggactcacctgaggagacagtgaccagggtgccacggccccagagatcgaagtaccgtcgacgttccgaatgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggttccgaatgagacctctgagcgggctggcaaggc

SEQ ID NO: 1948 - DNA, 495 bp, Artificial Sequence
  Oligonucleotide
gcctccctcgcgccatcaggttccgaagaatggactggcctggtgcctggacagagaagactgggagggggctgcagtgggactcacctgaggagacagtgaccagggtgccacggccccagagatcgaagtaccgtcgacgttccgaagaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgttccgaagaatggacctgagcgggctggcaaggc

SEQ ID NO: 1949 - DNA, 495 bp, Artificial Sequence
  Oligonucleotide
gcctccctcgcgccatcaggttccgaacacatggatggcctggtgcctggacagagaagactgggagggggctgcagtgggactcacctgaggagacagtgaccagggtgccacggccccagagatcgaagtaccgtcgacgttccgaacacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgttccgaacacatggactgagcgggctggcaaggc

SEQ ID NO: 1950 - DNA, 495 bp, Artificial Sequence
  Oligonucleotide
gcctccctcgcgccatcaggttccgaattgaccattggcctggtgcctggacagagaagactgggagggggctgcagtgggactcacctgaggagacagtgaccagggtgccacggccccagagatcgaagtaccgtcgacgttccgaattgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgttccgaattgaccatctgagcgggctggcaaggc

SEQ ID NO: 1951 - DNA, 495 bp, Artificial Sequence
  Oligonucleotide
gcctccctcgcgccatcaggttccgaaaagccatctggcctggtgcctggacagagaagactgggagggggctgcagtgggactcacctgaggagacagtgaccagggtgccacggccccagagatcgaagtaccgtcgacgttccgaaaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgttccgaaaagccatcctgagcgggctggcaaggc

SEQ ID NO: 1952 - DNA, 495 bp, Artificial Sequence
  Oligonucleotide
gcctccctcgcgccatcaggttccgaatccatgtgtggcctggtgcctggacagagaagactgggagggggctgcagtgggactcacctgaggagacagtgaccagggtgccacggccccagagatcgaagtaccgtcgacgttccgaatccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgttccgaatccatgtgctgagcgggctggcaaggc

SEQ ID NO: 1953 - DNA, 495 bp, Artificial Sequence
  Oligonucleotide
gcctccctcgcgccatcaggttccgaacaagtcactggcctggtgcctggacagagaagactgggagggggctgcagtgggactcacctgaggagacagtgaccagggtgccacggccccagagatcgaagtaccgtcgacgttccgaacaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgttccgaacaagtcacctgagcgggctggcaaggc

SEQ ID NO: 1954 - DNA, 495 bp, Artificial Sequence
  Oligonucleotide
gcctccctcgcgccatcaggttccgaactgcaatctggcctggtgcctggacagagaagactgggagggggctgcagtgggactcacctgaggagacagtgaccagggtgccacggccccagagatcgaagtaccgtcgacgttccgaactgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgttccgaactgcaatcctgagcgggctggcaaggc

SEQ ID NO: 1955 - DNA, 495 bp, Artificial Sequence
  Oligonucleotide
gcctccctcgcgccatcaggttccgaaatcgacgatggcctggtgcctggacagagaagactgggagggggctgcagtgggactcacctgaggagacagtgaccagggtgccacggccccagagatcgaagtaccgtcgacgttccgaaatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgttccgaaatcgacgactgagcgggctggcaaggc

SEQ ID NO: 1956 - DNA, 495 bp, Artificial Sequence
  Oligonucleotide
gcctccctcgcgccatcaggttccgaaacagactgtggcctggtgcctggacagagaagactgggagggggctgcagtgggactcacctgaggagacagtgaccagggtgccacggccccagagatcgaagtaccgtcgacgttccgaaacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagttccgaaacagactgctgagcgggctggcaaggc

SEQ ID NO: 1957 - DNA, 495 bp, Artificial Sequence
  Oligonucleotide
gcctccctcgcgccatcaggttccgaaccttatagtggcctggtgcctggacagagaagactgggagggggctgcagtgggactcacctgaggagacagtgaccagggtgccacggccccagagatcgaagtaccgtcgacgttccgaaccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgttccgaaccttatagctgagcgggctggcaaggc

SEQ ID NO: 1958 - DNA, 495 bp, Artificial Sequence
  Oligonucleotide
gcctccctcgcgccatcaggttccgaatacgcgtttggcctggtgcctggacagagaagactgggagggggctgcagtgggactcacctgaggagacagtgaccagggtgccacggccccagagatcgaagtaccgtcgacgttccgaatacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgttccgaatacgcgttctgagcgggctggcaaggc

SEQ ID NO: 1959 - DNA, 495 bp, Artificial Sequence
  Oligonucleotide
gcctccctcgcgccatcaggttccgaactataaggtggcctggtgcctggacagagaagactgggagggggctgcagtgggactcacctgaggagacagtgaccagggtgccacggccccagagatcgaagtaccgtcgacgttccgaactataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggttccgaactataaggctgagcgggctggcaaggc

SEQ ID NO: 1960 - DNA, 495 bp, Artificial Sequence
  Oligonucleotide
gcctccctcgcgccatcaggttccgaatcttagtctggcctggtgcctggacagagaagactgggagggggctgcagtgggactcacctgaggagacagtgaccagggtgccacggccccagagatcgaagtaccgtcgacgttccgaatcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgttccgaatcttagtcctgagcgggctggcaaggc

SEQ ID NO: 1961 - DNA, 495 bp, Artificial Sequence
  Oligonucleotide
gcctccctcgcgccatcaggttccgaatgtctgcatggcctggtgcctggacagagaagactgggagggggctgcagtgggactcacctgaggagacagtgaccagggtgccacggccccagagatcgaagtaccgtcgacgttccgaatgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgttccgaatgtctgcactgagcgggctggcaaggc

SEQ ID NO: 1962 - DNA, 495 bp, Artificial Sequence
  Oligonucleotide
gcctccctcgcgccatcaggttccgaagccattaatggcctggtgcctggacagagaagactgggagggggctgcagtgggactcacctgaggagacagtgaccagggtgccacggccccagagatcgaagtaccgtcgacgttccgaagccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgttccgaagccattaactgagcgggctggcaaggc

SEQ ID NO: 1963 - DNA, 495 bp, Artificial Sequence
  Oligonucleotide
gcctccctcgcgccatcaggttccgaagactaagatggcctggtgcctggacagagaagactgggagggggctgcagtgggactcacctgaggagacagtgaccagggtgccacggccccagagatcgaagtaccgtcgacgttccgaagactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggttccgaagactaagactgagcgggctggcaaggc

SEQ ID NO: 1964 - DNA, 495 bp, Artificial Sequence
  Oligonucleotide
gcctccctcgcgccatcaggttccgaaaggttgcttggcctggtgcctggacagagaagactgggagggggctgcagtgggactcacctgaggagacagtgaccagggtgccacggccccagagatcgaagtaccgtcgacgttccgaaaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggttccgaaaggttgctctgagcgggctggcaaggc

SEQ ID NO: 1965 - DNA, 495 bp, Artificial Sequence
  Oligonucleotide
gcctccctcgcgccatcaggttccgaactcgagaatggcctggtgcctggacagagaagactgggagggggctgcagtgggactcacctgaggagacagtgaccagggtgccacggccccagagatcgaagtaccgtcgacgttccgaactcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgttccgaactcgagaactgagcgggctggcaaggc

SEQ ID NO: 1966 - DNA, 495 bp, Artificial Sequence
  Oligonucleotide
gcctccctcgcgccatcaggttccgaattaatggctggcctggtgcctggacagagaagactgggagggggctgcagtgggactcacctgaggagacagtgaccagggtgccacggccccagagatcgaagtaccgtcgacgttccgaattaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgttccgaattaatggcctgagcgggctggcaaggc

SEQ ID NO: 1967 - DNA, 495 bp, Artificial Sequence
  Oligonucleotide
gcctccctcgcgccatcaggttccgaatgcagacatggcctggtgcctggacagagaagactgggagggggctgcagtgggactcacctgaggagacagtgaccagggtgccacggccccagagatcgaagtaccgtcgacgttccgaatgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagttccgaatgcagacactgagcgggctggcaaggc

SEQ ID NO: 1968 - DNA, 495 bp, Artificial Sequence
  Oligonucleotide
gcctccctcgcgccatcaggttccgaatcactgagtggcctggtgcctggacagagaagactgggagggggctgcagtgggactcacctgaggagacagtgaccagggtgccacggccccagagatcgaagtaccgtcgacgttccgaatcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgttccgaatcactgagctgagcgggctggcaaggc

SEQ ID NO: 1969 - DNA, 495 bp, Artificial Sequence
  Oligonucleotide
gcctccctcgcgccatcaggttccgaagagtacgttggcctggtgcctggacagagaagactgggagggggctgcagtgggactcacctgaggagacagtgaccagggtgccacggccccagagatcgaagtaccgtcgacgttccgaagagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgttccgaagagtacgtctgagcgggctggcaaggc

SEQ ID NO: 1970 - DNA, 495 bp, Artificial Sequence
  Oligonucleotide
gcctccctcgcgccatcaggttccgaaatacgccatggcctggtgcctggacagagaagactgggagggggctgcagtgggactcacctgaggagacagtgaccagggtgccacggccccagagatcgaagtaccgtcgacgttccgaaatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgttccgaaatacgccactgagcgggctggcaaggc

SEQ ID NO: 1971 - DNA, 495 bp, Artificial Sequence
  Oligonucleotide
gcctccctcgcgccatcaggttccgaatcgcatcatggcctggtgcctggacagagaagactgggagggggctgcagtgggactcacctgaggagacagtgaccagggtgccacggccccagagatcgaagtaccgtcgacgttccgaatcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgttccgaatcgcatcactgagcgggctggcaaggc

SEQ ID NO: 1972 - DNA, 495 bp, Artificial Sequence
  Oligonucleotide
gcctccctcgcgccatcaggttccgaacgcttaattggcctggtgcctggacagagaagactgggagggggctgcagtgggactcacctgaggagacagtgaccagggtgccacggccccagagatcgaagtaccgtcgacgttccgaacgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgttccgaacgcttaatctgagcgggctggcaaggc

SEQ ID NO: 1973 - DNA, 495 bp, Artificial Sequence
  Oligonucleotide
gcctccctcgcgccatcaggttccgaatggttatctggcctggtgcctggacagagaagactgggagggggctgcagtgggactcacctgaggagacagtgaccagggtgccacggccccagagatcgaagtaccgtcgacgttccgaatggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgttccgaatggttatcctgagcgggctggcaaggc

SEQ ID NO: 1974 - DNA, 495 bp, Artificial Sequence
  Oligonucleotide
gcctccctcgcgccatcaggttccgaaggattgcttggcctggtgcctggacagagaagactgggagggggctgcagtgggactcacctgaggagacagtgaccagggtgccacggccccagagatcgaagtaccgtcgacgttccgaaggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgttccgaaggattgctctgagcgggctggcaaggc

SEQ ID NO: 1975 - DNA, 495 bp, Artificial Sequence
  Oligonucleotide
gcctccctcgcgccatcaggttccgaactcagtgatggcctggtgcctggacagagaagactgggagggggctgcagtgggactcacctgaggagacagtgaccagggtgccacggccccagagatcgaagtaccgtcgacgttccgaactcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgttccgaactcagtgactgagcgggctggcaaggc

SEQ ID NO: 1976 - DNA, 495 bp, Artificial Sequence
  Oligonucleotide
gcctccctcgcgccatcaggttccgaaacgtactctggcctggtgcctggacagagaagactgggagggggctgcagtgggactcacctgaggagacagtgaccagggtgccacggccccagagatcgaagtaccgtcgacgttccgaaacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgttccgaaacgtactcctgagcgggctggcaaggc

SEQ ID NO: 1977 - DNA, 495 bp, Artificial Sequence
  Oligonucleotide
gcctccctcgcgccatcaggttccgaatgatgcgatggcctggtgcctggacagagaagactgggagggggctgcagtgggactcacctgaggagacagtgaccagggtgccacggccccagagatcgaagtaccgtcgacgttccgaatgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgttccgaatgatgcgactgagcgggctggcaaggc

SEQ ID NO: 1978 - DNA, 495 bp, Artificial Sequence
  Oligonucleotide
gcctccctcgcgccatcaggttccgaaattaagcgtggcctggtgcctggacagagaagactgggagggggctgcagtgggactcacctgaggagacagtgaccagggtgccacggccccagagatcgaagtaccgtcgacgttccgaaattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgttccgaaattaagcgctgagcgggctggcaaggc

SEQ ID NO: 1979 - DNA, 495 bp, Artificial Sequence
  Oligonucleotide
gcctccctcgcgccatcaggttccgaaagcaatcctggcctggtgcctggacagagaagactgggagggggctgcagtgggactcacctgaggagacagtgaccagggtgccacggccccagagatcgaagtaccgtcgacgttccgaaagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgttccgaaagcaatccctgagcgggctggcaaggc

SEQ ID NO: 1980 - DNA, 495 bp, Artificial Sequence
  Oligonucleotide
gcctccctcgcgccatcaggttccgaagcttagtatggcctggtgcctggacagagaagactgggagggggctgcagtgggactcacctgaggagacagtgaccagggtgccacggccccagagatcgaagtaccgtcgacgttccgaagcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagttccgaagcttagtactgagcgggctggcaaggc

SEQ ID NO: 1981 - DNA, 495 bp, Artificial Sequence
  Oligonucleotide
gcctccctcgcgccatcaggttccgaatgaccttgtggcctggtgcctggacagagaagactgggagggggctgcagtgggactcacctgaggagacagtgaccagggtgccacggccccagagatcgaagtaccgtcgacgttccgaatgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgttccgaatgaccttgctgagcgggctggcaaggc

SEQ ID NO: 1982 - DNA, 495 bp, Artificial Sequence
  Oligonucleotide
gcctccctcgcgccatcaggttccgaacaaggtcatggcctggtgcctggacagagaagactgggagggggctgcagtgggactcacctgaggagacagtgaccagggtgccacggccccagagatcgaagtaccgtcgacgttccgaacaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgttccgaacaaggtcactgagcgggctggcaaggc

SEQ ID NO: 1983 - DNA, 495 bp, Artificial Sequence
  Oligonucleotide
gcctccctcgcgccatcaggttccgaacactgtactggcctggtgcctggacagagaagactgggagggggctgcagtgggactcacctgaggagacagtgaccagggtgccacggccccagagatcgaagtaccgtcgacgttccgaacactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgttccgaacactgtacctgagcgggctggcaaggc

SEQ ID NO: 1984 - DNA, 495 bp, Artificial Sequence
  Oligonucleotide
gcctccctcgcgccatcaggttccgaagatgatcctggcctggtgcctggacagagaagactgggagggggctgcagtgggactcacctgaggagacagtgaccagggtgccacggccccagagatcgaagtaccgtcgacgttccgaagatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggttccgaagatgatccctgagcgggctggcaaggc

SEQ ID NO: 1985 - DNA, 495 bp, Artificial Sequence
  Oligonucleotide
gcctccctcgcgccatcaggttccgaacgccaatatggcctggtgcctggacagagaagactgggagggggctgcagtgggactcacctgaggagacagtgaccagggtgccacggccccagagatcgaagtaccgtcgacgttccgaacgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggttccgaacgccaatactgagcgggctggcaaggc

SEQ ID NO: 1986 - DNA, 495 bp, Artificial Sequence
  Oligonucleotide
gcctccctcgcgccatcaggttccgaatcaagccttggcctggtgcctggacagagaagactgggagggggctgcagtgggactcacctgaggagacagtgaccagggtgccacggccccagagatcgaagtaccgtcgacgttccgaatcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagttccgaatcaagcctctgagcgggctggcaaggc

SEQ ID NO: 1987 - DNA, 495 bp, Artificial Sequence
  Oligonucleotide
gcctccctcgcgccatcaggttccgaaacgtgtgttggcctggtgcctggacagagaagactgggagggggctgcagtgggactcacctgaggagacagtgaccagggtgccacggccccagagatcgaagtaccgtcgacgttccgaaacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggttccgaaacgtgtgtctgagcgggctggcaaggc

SEQ ID NO: 1988 - DNA, 495 bp, Artificial Sequence
  Oligonucleotide
gcctccctcgcgccatcaggttccgaatccgtctatggcctggtgcctggacagagaagactgggagggggctgcagtgggactcacctgaggagacagtgaccagggtgccacggccccagagatcgaagtaccgtcgacgttccgaatccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggttccgaatccgtctactgagcgggctggcaaggc

SEQ ID NO: 1989 - DNA, 495 bp, Artificial Sequence
  Oligonucleotide
gcctccctcgcgccatcaggttccgaaaagagctgtggcctggtgcctggacagagaagactgggagggggctgcagtgggactcacctgaggagacagtgaccagggtgccacggccccagagatcgaagtaccgtcgacgttccgaaaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggttccgaaaagagctgctgagcgggctggcaaggc

SEQ ID NO: 1990 - DNA, 495 bp, Artificial Sequence
  Oligonucleotide
gcctccctcgcgccatcaggttccgaatatcgctctggcctggtgcctggacagagaagactgggagggggctgcagtgggactcacctgaggagacagtgaccagggtgccacggccccagagatcgaagtaccgtcgacgttccgaatatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggttccgaatatcgctcctgagcgggctggcaaggc

SEQ ID NO: 1991 - DNA, 495 bp, Artificial Sequence
  Oligonucleotide
gcctccctcgcgccatcaggttccgaatcagatgctggcctggtgcctggacagagaagactgggagggggctgcagtgggactcacctgaggagacagtgaccagggtgccacggccccagagatcgaagtaccgtcgacgttccgaatcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgttccgaatcagatgcctgagcgggctggcaaggc

SEQ ID NO: 1992 - DNA, 495 bp, Artificial Sequence
  Oligonucleotide
gcctccctcgcgccatcaggttccgaagtgtagcatggcctggtgcctggacagagaagactgggagggggctgcagtgggactcacctgaggagacagtgaccagggtgccacggccccagagatcgaagtaccgtcgacgttccgaagtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggttccgaagtgtagcactgagcgggctggcaaggc

SEQ ID NO: 1993 - DNA, 495 bp, Artificial Sequence
  Oligonucleotide
gcctccctcgcgccatcaggttccgaatggcagtttggcctggtgcctggacagagaagactgggagggggctgcagtgggactcacctgaggagacagtgaccagggtgccacggccccagagatcgaagtaccgtcgacgttccgaatggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggttccgaatggcagttctgagcgggctggcaaggc

SEQ ID NO: 1994 - DNA, 495 bp, Artificial Sequence
  Oligonucleotide
gcctccctcgcgccatcaggttccgaacagtccaatggcctggtgcctggacagagaagactgggagggggctgcagtgggactcacctgaggagacagtgaccagggtgccacggccccagagatcgaagtaccgtcgacgttccgaacagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgttccgaacagtccaactgagcgggctggcaaggc

SEQ ID NO: 1995 - DNA, 495 bp, Artificial Sequence
  Oligonucleotide
gcctccctcgcgccatcaggttccgaagtgtctactggcctggtgcctggacagagaagactgggagggggctgcagtgggactcacctgaggagacagtgaccagggtgccacggccccagagatcgaagtaccgtcgacgttccgaagtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggttccgaagtgtctacctgagcgggctggcaaggc

SEQ ID NO: 1996 - DNA, 495 bp, Artificial Sequence
  Oligonucleotide
gcctccctcgcgccatcaggttccgaagtacagtgtggcctggtgcctggacagagaagactgggagggggctgcagtgggactcacctgaggagacagtgaccagggtgccacggccccagagatcgaagtaccgtcgacgttccgaagtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggttccgaagtacagtgctgagcgggctggcaaggc

SEQ ID NO: 1997 - DNA, 495 bp, Artificial Sequence
  Oligonucleotide
gcctccctcgcgccatcaggttccgaaggatcatctggcctggtgcctggacagagaagactgggagggggctgcagtgggactcacctgaggagacagtgaccagggtgccacggccccagagatcgaagtaccgtcgacgttccgaaggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggttccgaaggatcatcctgagcgggctggcaaggc

SEQ ID NO: 1998 - DNA, 495 bp, Artificial Sequence
  Oligonucleotide
gcctccctcgcgccatcaggttccgaatattggcgtggcctggtgcctggacagagaagactgggagggggctgcagtgggactcacctgaggagacagtgaccagggtgccacggccccagagatcgaagtaccgtcgacgttccgaatattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagttccgaatattggcgctgagcgggctggcaaggc

SEQ ID NO: 1999 - DNA, 495 bp, Artificial Sequence
  Oligonucleotide
gcctccctcgcgccatcaggttccgaaaggcttgatggcctggtgcctggacagagaagactgggagggggctgcagtgggactcacctgaggagacagtgaccagggtgccacggccccagagatcgaagtaccgtcgacgttccgaaaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgttccgaaaggcttgactgagcgggctggcaaggc

SEQ ID NO: 2000 - DNA, 495 bp, Artificial Sequence
  Oligonucleotide
gcctccctcgcgccatcaggttccgaaacacacgttggcctggtgcctggacagagaagactgggagggggctgcagtgggactcacctgaggagacagtgaccagggtgccacggccccagagatcgaagtaccgtcgacgttccgaaacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgttccgaaacacacgtctgagcgggctggcaaggc

SEQ ID NO: 2001 - DNA, 495 bp, Artificial Sequence
  Oligonucleotide
gcctccctcgcgccatcaggttccgaatagacggatggcctggtgcctggacagagaagactgggagggggctgcagtgggactcacctgaggagacagtgaccagggtgccacggccccagagatcgaagtaccgtcgacgttccgaatagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagttccgaatagacggactgagcgggctggcaaggc

SEQ ID NO: 2002 - DNA, 495 bp, Artificial Sequence
  Oligonucleotide
gcctccctcgcgccatcaggttccgaagagcgatatggcctggtgcctggacagagaagactgggagggggctgcagtgggactcacctgaggagacagtgaccagggtgccacggccccagagatcgaagtaccgtcgacgttccgaagagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgttccgaagagcgatactgagcgggctggcaaggc

SEQ ID NO: 2003 - DNA, 495 bp, Artificial Sequence
  Oligonucleotide
gcctccctcgcgccatcaggttccgaagcatctgatggcctggtgcctggacagagaagactgggagggggctgcagtgggactcacctgaggagacagtgaccagggtgccacggccccagagatcgaagtaccgtcgacgttccgaagcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagttccgaagcatctgactgagcgggctggcaaggc

SEQ ID NO: 2004 - DNA, 495 bp, Artificial Sequence
  Oligonucleotide
gcctccctcgcgccatcaggttccgaatgctacactggcctggtgcctggacagagaagactgggagggggctgcagtgggactcacctgaggagacagtgaccagggtgccacggccccagagatcgaagtaccgtcgacgttccgaatgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggttccgaatgctacacctgagcgggctggcaaggc

SEQ ID NO: 2005 - DNA, 495 bp, Artificial Sequence
  Oligonucleotide
gcctccctcgcgccatcaggttccgaaaactgccatggcctggtgcctggacagagaagactgggagggggctgcagtgggactcacctgaggagacagtgaccagggtgccacggccccagagatcgaagtaccgtcgacgttccgaaaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgttccgaaaactgccactgagcgggctggcaaggc

SEQ ID NO: 2006 - DNA, 495 bp, Artificial Sequence
  Oligonucleotide
gcctccctcgcgccatcaggttccgaattggactgtggcctggtgcctggacagagaagactgggagggggctgcagtgggactcacctgaggagacagtgaccagggtgccacggccccagagatcgaagtaccgtcgacgttccgaattggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggttccgaattggactgctgagcgggctggcaaggc

SEQ ID NO: 2007 - DNA, 495 bp, Artificial Sequence
  Oligonucleotide
gcctccctcgcgccatcaggttccgaatcggtacttggcctggtgcctggacagagaagactgggagggggctgcagtgggactcacctgaggagacagtgaccagggtgccacggccccagagatcgaagtaccgtcgacgttccgaatcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggttccgaatcggtactctgagcgggctggcaaggc

SEQ ID NO: 2008 - DNA, 495 bp, Artificial Sequence
  Oligonucleotide
gcctccctcgcgccatcaggttccgaaccatggattggcctggtgcctggacagagaagactgggagggggctgcagtgggactcacctgaggagacagtgaccagggtgccacggccccagagatcgaagtaccgtcgacgttccgaaccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgttccgaaccatggatctgagcgggctggcaaggc

SEQ ID NO: 2009 - DNA, 495 bp, Artificial Sequence
  Oligonucleotide
gcctccctcgcgccatcaggttccgaaacgaagattggcctggtgcctggacagagaagactgggagggggctgcagtgggactcacctgaggagacagtgaccagggtgccacggccccagagatcgaagtaccgtcgacgttccgaaacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagttccgaaacgaagatctgagcgggctggcaaggc

SEQ ID NO: 2010 - DNA, 495 bp, Artificial Sequence
  Oligonucleotide
gcctccctcgcgccatcaggttccgaaactgtggatggcctggtgcctggacagagaagactgggagggggctgcagtgggactcacctgaggagacagtgaccagggtgccacggccccagagatcgaagtaccgtcgacgttccgaaactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgttccgaaactgtggactgagcgggctggcaaggc

SEQ ID NO: 2011 - DNA, 495 bp, Artificial Sequence
  Oligonucleotide
gcctccctcgcgccatcaggttccgaaggtgtcattggcctggtgcctggacagagaagactgggagggggctgcagtgggactcacctgaggagacagtgaccagggtgccacggccccagagatcgaagtaccgtcgacgttccgaaggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgttccgaaggtgtcatctgagcgggctggcaaggc

SEQ ID NO: 2012 - DNA, 495 bp, Artificial Sequence
  Oligonucleotide
gcctccctcgcgccatcaggttccgaatcgtgaagtggcctggtgcctggacagagaagactgggagggggctgcagtgggactcacctgaggagacagtgaccagggtgccacggccccagagatcgaagtaccgtcgacgttccgaatcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggttccgaatcgtgaagctgagcgggctggcaaggc

SEQ ID NO: 2013 - DNA, 495 bp, Artificial Sequence
  Oligonucleotide
gcctccctcgcgccatcaggttccgaacactagcttggcctggtgcctggacagagaagactgggagggggctgcagtgggactcacctgaggagacagtgaccagggtgccacggccccagagatcgaagtaccgtcgacgttccgaacactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagttccgaacactagctctgagcgggctggcaaggc

SEQ ID NO: 2014 - DNA, 495 bp, Artificial Sequence
  Oligonucleotide
gcctccctcgcgccatcaggttccgaaggtcaacttggcctggtgcctggacagagaagactgggagggggctgcagtgggactcacctgaggagacagtgaccagggtgccacggccccagagatcgaagtaccgtcgacgttccgaaggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagttccgaaggtcaactctgagcgggctggcaaggc

SEQ ID NO: 2015 - DNA, 495 bp, Artificial Sequence
  Oligonucleotide
gcctccctcgcgccatcaggttccgaatacgtacgtggcctggtgcctggacagagaagactgggagggggctgcagtgggactcacctgaggagacagtgaccagggtgccacggccccagagatcgaagtaccgtcgacgttccgaatacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgttccgaatacgtacgctgagcgggctggcaaggc

SEQ ID NO: 2016 - DNA, 495 bp, Artificial Sequence
  Oligonucleotide
gcctccctcgcgccatcaggttccgaaatgacacctggcctggtgcctggacagagaagactgggagggggctgcagtgggactcacctgaggagacagtgaccagggtgccacggccccagagatcgaagtaccgtcgacgttccgaaatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggttccgaaatgacaccctgagcgggctggcaaggc

SEQ ID NO: 2017 - DNA, 495 bp, Artificial Sequence
  Oligonucleotide
gcctccctcgcgccatcaggttccgaacttcacgatggcctggtgcctggacagagaagactgggagggggctgcagtgggactcacctgaggagacagtgaccagggtgccacggccccagagatcgaagtaccgtcgacgttccgaacttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgttccgaacttcacgactgagcgggctggcaaggc

SEQ ID NO: 2018 - DNA, 495 bp, Artificial Sequence
  Oligonucleotide
gcctccctcgcgccatcaggttccgaaagaatcagtggcctggtgcctggacagagaagactgggagggggctgcagtgggactcacctgaggagacagtgaccagggtgccacggccccagagatcgaagtaccgtcgacgttccgaaagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgttccgaaagaatcagctgagcgggctggcaaggc

SEQ ID NO: 2019 - DNA, 495 bp, Artificial Sequence
  Oligonucleotide
gcctccctcgcgccatcaggttccgaaagttatgctggcctggtgcctggacagagaagactgggagggggctgcagtgggactcacctgaggagacagtgaccagggtgccacggccccagagatcgaagtaccgtcgacgttccgaaagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagttccgaaagttatgcctgagcgggctggcaaggc

SEQ ID NO: 2020 - DNA, 495 bp, Artificial Sequence
  Oligonucleotide
gcctccctcgcgccatcaggttccgaaaggtctcatggcctggtgcctggacagagaagactgggagggggctgcagtgggactcacctgaggagacagtgaccagggtgccacggccccagagatcgaagtaccgtcgacgttccgaaaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgttccgaaaggtctcactgagcgggctggcaaggc

SEQ ID NO: 2021 - DNA, 495 bp, Artificial Sequence
  Oligonucleotide
gcctccctcgcgccatcaggttccgaagtcatagttggcctggtgcctggacagagaagactgggagggggctgcagtgggactcacctgaggagacagtgaccagggtgccacggccccagagatcgaagtaccgtcgacgttccgaagtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgttccgaagtcatagtctgagcgggctggcaaggc

SEQ ID NO: 2022 - DNA, 495 bp, Artificial Sequence
  Oligonucleotide
gcctccctcgcgccatcaggttccgaagtgacttgtggcctggtgcctggacagagaagactgggagggggctgcagtgggactcacctgaggagacagtgaccagggtgccacggccccagagatcgaagtaccgtcgacgttccgaagtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggttccgaagtgacttgctgagcgggctggcaaggc

SEQ ID NO: 2023 - DNA, 495 bp, Artificial Sequence
  Oligonucleotide
gcctccctcgcgccatcaggttccgaagattgcagtggcctggtgcctggacagagaagactgggagggggctgcagtgggactcacctgaggagacagtgaccagggtgccacggccccagagatcgaagtaccgtcgacgttccgaagattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgttccgaagattgcagctgagcgggctggcaaggc

SEQ ID NO: 2024 - DNA, 495 bp, Artificial Sequence
  Oligonucleotide
gcctccctcgcgccatcaggttccgaaactatgactggcctggtgcctggacagagaagactgggagggggctgcagtgggactcacctgaggagacagtgaccagggtgccacggccccagagatcgaagtaccgtcgacgttccgaaactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgttccgaaactatgacctgagcgggctggcaaggc

SEQ ID NO: 2025 - DNA, 495 bp, Artificial Sequence
  Oligonucleotide
gcctccctcgcgccatcaggttccgaaatggtcaatggcctggtgcctggacagagaagactgggagggggctgcagtgggactcacctgaggagacagtgaccagggtgccacggccccagagatcgaagtaccgtcgacgttccgaaatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgttccgaaatggtcaactgagcgggctggcaaggc

SEQ ID NO: 2026 - DNA, 495 bp, Artificial Sequence
  Oligonucleotide
gcctccctcgcgccatcaggttccgaagatggctttggcctggtgcctggacagagaagactgggagggggctgcagtgggactcacctgaggagacagtgaccagggtgccacggccccagagatcgaagtaccgtcgacgttccgaagatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgttccgaagatggcttctgagcgggctggcaaggc

SEQ ID NO: 2027 - DNA, 495 bp, Artificial Sequence
  Oligonucleotide
gcctccctcgcgccatcaggttccgaaagcatatgtggcctggtgcctggacagagaagactgggagggggctgcagtgggactcacctgaggagacagtgaccagggtgccacggccccagagatcgaagtaccgtcgacgttccgaaagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgttccgaaagcatatgctgagcgggctggcaaggc

SEQ ID NO: 2028 - DNA, 495 bp, Artificial Sequence
  Oligonucleotide
gcctccctcgcgccatcaggttccgaacatatgcttggcctggtgcctggacagagaagactgggagggggctgcagtgggactcacctgaggagacagtgaccagggtgccacggccccagagatcgaagtaccgtcgacgttccgaacatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggttccgaacatatgctctgagcgggctggcaaggc

SEQ ID NO: 2029 - DNA, 495 bp, Artificial Sequence
  Oligonucleotide
gcctccctcgcgccatcaggttccgaatcgtcgattggcctggtgcctggacagagaagactgggagggggctgcagtgggactcacctgaggagacagtgaccagggtgccacggccccagagatcgaagtaccgtcgacgttccgaatcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgttccgaatcgtcgatctgagcgggctggcaaggc

SEQ ID NO: 2030 - DNA, 495 bp, Artificial Sequence
  Oligonucleotide
gcctccctcgcgccatcaggttccgaacagtctgttggcctggtgcctggacagagaagactgggagggggctgcagtgggactcacctgaggagacagtgaccagggtgccacggccccagagatcgaagtaccgtcgacgttccgaacagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgttccgaacagtctgtctgagcgggctggcaaggc

SEQ ID NO: 2031 - DNA, 495 bp, Artificial Sequence
  Oligonucleotide
gcctccctcgcgccatcaggttccgaaaacgcgtatggcctggtgcctggacagagaagactgggagggggctgcagtgggactcacctgaggagacagtgaccagggtgccacggccccagagatcgaagtaccgtcgacgttccgaaaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggttccgaaaacgcgtactgagcgggctggcaaggc

SEQ ID NO: 2032 - DNA, 495 bp, Artificial Sequence
  Oligonucleotide
gcctccctcgcgccatcaggttccgaagtagttcgtggcctggtgcctggacagagaagactgggagggggctgcagtgggactcacctgaggagacagtgaccagggtgccacggccccagagatcgaagtaccgtcgacgttccgaagtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgttccgaagtagttcgctgagcgggctggcaaggc

SEQ ID NO: 2033 - DNA, 495 bp, Artificial Sequence
  Oligonucleotide
gcctccctcgcgccatcaggttccgaacgaactactggcctggtgcctggacagagaagactgggagggggctgcagtgggactcacctgaggagacagtgaccagggtgccacggccccagagatcgaagtaccgtcgacgttccgaacgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgttccgaacgaactacctgagcgggctggcaaggc

SEQ ID NO: 2034 - DNA, 495 bp, Artificial Sequence
  Oligonucleotide
gcctccctcgcgccatcaggttccgaattaacgtctggcctggtgcctggacagagaagactgggagggggctgcagtgggactcacctgaggagacagtgaccagggtgccacggccccagagatcgaagtaccgtcgacgttccgaattaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgttccgaattaacgtcctgagcgggctggcaaggc

SEQ ID NO: 2035 - DNA, 495 bp, Artificial Sequence
  Oligonucleotide
gcctccctcgcgccatcaggttccgaaagcaaccttggcctggtgcctggacagagaagactgggagggggctgcagtgggactcacctgaggagacagtgaccagggtgccacggccccagagatcgaagtaccgtcgacgttccgaaagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgttccgaaagcaacctctgagcgggctggcaaggc

SEQ ID NO: 2036 - DNA, 495 bp, Artificial Sequence
  Oligonucleotide
gcctccctcgcgccatcaggttccgaattctcgagtggcctggtgcctggacagagaagactgggagggggctgcagtgggactcacctgaggagacagtgaccagggtgccacggccccagagatcgaagtaccgtcgacgttccgaattctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgttccgaattctcgagctgagcgggctggcaaggc

SEQ ID NO: 2037 - DNA, 495 bp, Artificial Sequence
  Oligonucleotide
gcctccctcgcgccatcaggttccgaaactctacgtggcctggtgcctggacagagaagactgggagggggctgcagtgggactcacctgaggagacagtgaccagggtgccacggccccagagatcgaagtaccgtcgacgttccgaaactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgttccgaaactctacgctgagcgggctggcaaggc

SEQ ID NO: 2038 - DNA, 495 bp, Artificial Sequence
  Oligonucleotide
gcctccctcgcgccatcaggttccgaataccggaatggcctggtgcctggacagagaagactgggagggggctgcagtgggactcacctgaggagacagtgaccagggtgccacggccccagagatcgaagtaccgtcgacgttccgaataccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgttccgaataccggaactgagcgggctggcaaggc

SEQ ID NO: 2039 - DNA, 495 bp, Artificial Sequence
  Oligonucleotide
gcctccctcgcgccatcaggttccgaacgaattgctggcctggtgcctggacagagaagactgggagggggctgcagtgggactcacctgaggagacagtgaccagggtgccacggccccagagatcgaagtaccgtcgacgttccgaacgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgttccgaacgaattgcctgagcgggctggcaaggc

SEQ ID NO: 2040 - DNA, 495 bp, Artificial Sequence
  Oligonucleotide
gcctccctcgcgccatcaggttccgaattcgctcatggcctggtgcctggacagagaagactgggagggggctgcagtgggactcacctgaggagacagtgaccagggtgccacggccccagagatcgaagtaccgtcgacgttccgaattcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagttccgaattcgctcactgagcgggctggcaaggc

SEQ ID NO: 2041 - DNA, 495 bp, Artificial Sequence
  Oligonucleotide
gcctccctcgcgccatcaggttccgaagacgttaatggcctggtgcctggacagagaagactgggagggggctgcagtgggactcacctgaggagacagtgaccagggtgccacggccccagagatcgaagtaccgtcgacgttccgaagacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggttccgaagacgttaactgagcgggctggcaaggc

SEQ ID NO: 2042 - DNA, 495 bp, Artificial Sequence
  Oligonucleotide
gcctccctcgcgccatcaggttccgaacgtagagttggcctggtgcctggacagagaagactgggagggggctgcagtgggactcacctgaggagacagtgaccagggtgccacggccccagagatcgaagtaccgtcgacgttccgaacgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgttccgaacgtagagtctgagcgggctggcaaggc

SEQ ID NO: 2043 - DNA, 495 bp, Artificial Sequence
  Oligonucleotide
gcctccctcgcgccatcaggttccgaattccggtatggcctggtgcctggacagagaagactgggagggggctgcagtgggactcacctgaggagacagtgaccagggtgccacggccccagagatcgaagtaccgtcgacgttccgaattccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgttccgaattccggtactgagcgggctggcaaggc

SEQ ID NO: 2044 - DNA, 495 bp, Artificial Sequence
  Oligonucleotide
gcctccctcgcgccatcaggttccgaagcaattcgtggcctggtgcctggacagagaagactgggagggggctgcagtgggactcacctgaggagacagtgaccagggtgccacggccccagagatcgaagtaccgtcgacgttccgaagcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgttccgaagcaattcgctgagcgggctggcaaggc

SEQ ID NO: 2045 - DNA, 495 bp, Artificial Sequence
  Oligonucleotide
gcctccctcgcgccatcaggttccgaatgagcgaatggcctggtgcctggacagagaagactgggagggggctgcagtgggactcacctgaggagacagtgaccagggtgccacggccccagagatcgaagtaccgtcgacgttccgaatgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgttccgaatgagcgaactgagcgggctggcaaggc

SEQ ID NO: 2046 - DNA, 495 bp, Artificial Sequence
  Oligonucleotide
gcctccctcgcgccatcaggttccgaatactaagctggcctggtgcctggacagagaagactgggagggggctgcagtgggactcacctgaggagacagtgaccagggtgccacggccccagagatcgaagtaccgtcgacgttccgaatactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgttccgaatactaagcctgagcgggctggcaaggc

SEQ ID NO: 2047 - DNA, 495 bp, Artificial Sequence
  Oligonucleotide
gcctccctcgcgccatcaggttccgaatggcgtattggcctggtgcctggacagagaagactgggagggggctgcagtgggactcacctgaggagacagtgaccagggtgccacggccccagagatcgaagtaccgtcgacgttccgaatggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgttccgaatggcgtatctgagcgggctggcaaggc

SEQ ID NO: 2048 - DNA, 495 bp, Artificial Sequence
  Oligonucleotide
gcctccctcgcgccatcaggttccgaagataaccatggcctggtgcctggacagagaagactgggagggggctgcagtgggactcacctgaggagacagtgaccagggtgccacggccccagagatcgaagtaccgtcgacgttccgaagataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggttccgaagataaccactgagcgggctggcaaggc

SEQ ID NO: 2049 - DNA, 495 bp, Artificial Sequence
  Oligonucleotide
gcctccctcgcgccatcaggttccgaactagtgaatggcctggtgcctggacagagaagactgggagggggctgcagtgggactcacctgaggagacagtgaccagggtgccacggccccagagatcgaagtaccgtcgacgttccgaactagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggttccgaactagtgaactgagcgggctggcaaggc

SEQ ID NO: 2050 - DNA, 495 bp, Artificial Sequence
  Oligonucleotide
gcctccctcgcgccatcaggttccgaaacgttcactggcctggtgcctggacagagaagactgggagggggctgcagtgggactcacctgaggagacagtgaccagggtgccacggccccagagatcgaagtaccgtcgacgttccgaaacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgttccgaaacgttcacctgagcgggctggcaaggc

SEQ ID NO: 2051 - DNA, 448 bp, Artificial Sequence
  Oligonucleotide
gcctccctcgcgccatcaggttccgaaattacgcttggcctggtgcctggacagagaagactgggagggggctgcagtgggactcacctgaggagacagtgaccagggtgccacggccccagagatcgaagtaccgtcgacgttccgaaattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagttccgaaattacgctctgagcgggctggcaaggc

SEQ ID NO: 2052 - DNA, 495 bp, Artificial Sequence
  Oligonucleotide
gcctccctcgcgccatcaggttccgaacattgagttggcctggtgcctggacagagaagactgggagggggctgcagtgggactcacctgaggagacagtgaccagggtgccacggccccagagatcgaagtaccgtcgacgttccgaacattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgttccgaacattgagtctgagcgggctggcaaggc

SEQ ID NO: 2053 - DNA, 495 bp, Artificial Sequence
  Oligonucleotide
gcctccctcgcgccatcagcgttacttcttggttaccaggacagaggacgctgggcccagagaaaggaggcagaaggaaagccatcttacctgaagagacggtgaccattgtcccttggccccagatatcaaaaggtcgaccgttacttcttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcccgttacttcttggttactgagcgggctggcaaggc

SEQ ID NO: 2054 - DNA, 495 bp, Artificial Sequence
  Oligonucleotide
gcctccctcgcgccatcagcgttacttacctcttgccaggacagaggacgctgggcccagagaaaggaggcagaaggaaagccatcttacctgaagagacggtgaccattgtcccttggccccagatatcaaaaggtcgaccgttacttacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacccgttacttacctcttgctgagcgggctggcaaggc

SEQ ID NO: 2055 - DNA, 495 bp, Artificial Sequence
  Oligonucleotide
gcctccctcgcgccatcagcgttacttctgattctccaggacagaggacgctgggcccagagaaaggaggcagaaggaaagccatcttacctgaagagacggtgaccattgtcccttggccccagatatcaaaaggtcgaccgttacttctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcacccgttacttctgattctctgagcgggctggcaaggc

SEQ ID NO: 2056 - DNA, 495 bp, Artificial Sequence
  Oligonucleotide
gcctccctcgcgccatcagcgttacttagtaccgaccaggacagaggacgctgggcccagagaaaggaggcagaaggaaagccatcttacctgaagagacggtgaccattgtcccttggccccagatatcaaaaggtcgaccgttacttagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcacccgttacttagtaccgactgagcgggctggcaaggc

SEQ ID NO: 2057 - DNA, 495 bp, Artificial Sequence
  Oligonucleotide
gcctccctcgcgccatcagcgttacttatccatggccaggacagaggacgctgggcccagagaaaggaggcagaaggaaagccatcttacctgaagagacggtgaccattgtcccttggccccagatatcaaaaggtcgaccgttacttatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgcccgttacttatccatggctgagcgggctggcaaggc

SEQ ID NO: 2058 - DNA, 495 bp, Artificial Sequence
  Oligonucleotide
gcctccctcgcgccatcagcgttacttgtagcagtccaggacagaggacgctgggcccagagaaaggaggcagaaggaaagccatcttacctgaagagacggtgaccattgtcccttggccccagatatcaaaaggtcgaccgttacttgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatccgttacttgtagcagtctgagcgggctggcaaggc

SEQ ID NO: 2059 - DNA, 495 bp, Artificial Sequence
  Oligonucleotide
gcctccctcgcgccatcagcgttacttatcttcgtccaggacagaggacgctgggcccagagaaaggaggcagaaggaaagccatcttacctgaagagacggtgaccattgtcccttggccccagatatcaaaaggtcgaccgttacttatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcacccgttacttatcttcgtctgagcgggctggcaaggc

SEQ ID NO: 2060 - DNA, 495 bp, Artificial Sequence
  Oligonucleotide
gcctccctcgcgccatcagcgttactttccacagtccaggacagaggacgctgggcccagagaaaggaggcagaaggaaagccatcttacctgaagagacggtgaccattgtcccttggccccagatatcaaaaggtcgaccgttactttccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcacccgttactttccacagtctgagcgggctggcaaggc

SEQ ID NO: 2061 - DNA, 495 bp, Artificial Sequence
  Oligonucleotide
gcctccctcgcgccatcagcgttacttagctagtgccaggacagaggacgctgggcccagagaaaggaggcagaaggaaagccatcttacctgaagagacggtgaccattgtcccttggccccagatatcaaaaggtcgaccgttacttagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacacccgttacttagctagtgctgagcgggctggcaaggc

SEQ ID NO: 2062 - DNA, 495 bp, Artificial Sequence
  Oligonucleotide
gcctccctcgcgccatcagcgttactttaaccaagccaggacagaggacgctgggcccagagaaaggaggcagaaggaaagccatcttacctgaagagacggtgaccattgtcccttggccccagatatcaaaaggtcgaccgttactttaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcacccgttactttaaccaagctgagcgggctggcaaggc

SEQ ID NO: 2063 - DNA, 495 bp, Artificial Sequence
  Oligonucleotide
gcctccctcgcgccatcagcgttacttcaagaggtccaggacagaggacgctgggcccagagaaaggaggcagaaggaaagccatcttacctgaagagacggtgaccattgtcccttggccccagatatcaaaaggtcgaccgttacttcaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgcccgttacttcaagaggtctgagcgggctggcaaggc

SEQ ID NO: 2064 - DNA, 495 bp, Artificial Sequence
  Oligonucleotide
gcctccctcgcgccatcagcgttacttagttgaccccaggacagaggacgctgggcccagagaaaggaggcagaaggaaagccatcttacctgaagagacggtgaccattgtcccttggccccagatatcaaaaggtcgaccgttacttagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaacgttacttagttgaccctgagcgggctggcaaggc

SEQ ID NO: 2065 - DNA, 495 bp, Artificial Sequence
  Oligonucleotide
gcctccctcgcgccatcagcgttacttcagcatatccaggacagaggacgctgggcccagagaaaggaggcagaaggaaagccatcttacctgaagagacggtgaccattgtcccttggccccagatatcaaaaggtcgaccgttacttcagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaacgttacttcagcatatctgagcgggctggcaaggc

SEQ ID NO: 2066 - DNA, 495 bp, Artificial Sequence
  Oligonucleotide
gcctccctcgcgccatcagcgttacttgcaggattccaggacagaggacgctgggcccagagaaaggaggcagaaggaaagccatcttacctgaagagacggtgaccattgtcccttggccccagatatcaaaaggtcgaccgttacttgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataacgttacttgcaggattctgagcgggctggcaaggc

SEQ ID NO: 2067 - DNA, 495 bp, Artificial Sequence
  Oligonucleotide
gcctccctcgcgccatcagcgttacttgtccattcccaggacagaggacgctgggcccagagaaaggaggcagaaggaaagccatcttacctgaagagacggtgaccattgtcccttggccccagatatcaaaaggtcgaccgttacttgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacacccgttacttgtccattcctgagcgggctggcaaggc

SEQ ID NO: 2068 - DNA, 495 bp, Artificial Sequence
  Oligonucleotide
gcctccctcgcgccatcagcgttacttgcataactccaggacagaggacgctgggcccagagaaaggaggcagaaggaaagccatcttacctgaagagacggtgaccattgtcccttggccccagatatcaaaaggtcgaccgttacttgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggaccgttacttgcataactctgagcgggctggcaaggc

SEQ ID NO: 2069 - DNA, 495 bp, Artificial Sequence
  Oligonucleotide
gcctccctcgcgccatcagcgttacttatatgctgccaggacagaggacgctgggcccagagaaaggaggcagaaggaaagccatcttacctgaagagacggtgaccattgtcccttggccccagatatcaaaaggtcgaccgttacttatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacacccgttacttatatgctgctgagcgggctggcaaggc

SEQ ID NO: 2070 - DNA, 495 bp, Artificial Sequence
  Oligonucleotide
gcctccctcgcgccatcagcgttacttaatcctgcccaggacagaggacgctgggcccagagaaaggaggcagaaggaaagccatcttacctgaagagacggtgaccattgtcccttggccccagatatcaaaaggtcgaccgttacttaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgccgttacttaatcctgcctgagcgggctggcaaggc

SEQ ID NO: 2071 - DNA, 495 bp, Artificial Sequence
  Oligonucleotide
gcctccctcgcgccatcagcgttactttgagacctccaggacagaggacgctgggcccagagaaaggaggcagaaggaaagccatcttacctgaagagacggtgaccattgtcccttggccccagatatcaaaaggtcgaccgttactttgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgcgttactttgagacctctgagcgggctggcaaggc

SEQ ID NO: 2072 - DNA, 495 bp, Artificial Sequence
  Oligonucleotide
gcctccctcgcgccatcagcgttacttgaatggacccaggacagaggacgctgggcccagagaaaggaggcagaaggaaagccatcttacctgaagagacggtgaccattgtcccttggccccagatatcaaaaggtcgaccgttacttgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacacccgttacttgaatggacctgagcgggctggcaaggc

SEQ ID NO: 2073 - DNA, 495 bp, Artificial Sequence
  Oligonucleotide
gcctccctcgcgccatcagcgttacttcacatggaccaggacagaggacgctgggcccagagaaaggaggcagaaggaaagccatcttacctgaagagacggtgaccattgtcccttggccccagatatcaaaaggtcgaccgttacttcacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacacccgttacttcacatggactgagcgggctggcaaggc

SEQ ID NO: 2074 - DNA, 495 bp, Artificial Sequence
  Oligonucleotide
gcctccctcgcgccatcagcgttacttttgaccatccaggacagaggacgctgggcccagagaaaggaggcagaaggaaagccatcttacctgaagagacggtgaccattgtcccttggccccagatatcaaaaggtcgaccgttacttttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacacccgttacttttgaccatctgagcgggctggcaaggc

SEQ ID NO: 2075 - DNA, 495 bp, Artificial Sequence
  Oligonucleotide
gcctccctcgcgccatcagcgttacttaagccatcccaggacagaggacgctgggcccagagaaaggaggcagaaggaaagccatcttacctgaagagacggtgaccattgtcccttggccccagatatcaaaaggtcgaccgttacttaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacacccgttacttaagccatcctgagcgggctggcaaggc

SEQ ID NO: 2076 - DNA, 495 bp, Artificial Sequence
  Oligonucleotide
gcctccctcgcgccatcagcgttactttccatgtgccaggacagaggacgctgggcccagagaaaggaggcagaaggaaagccatcttacctgaagagacggtgaccattgtcccttggccccagatatcaaaaggtcgaccgttactttccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacccgttactttccatgtgctgagcgggctggcaaggc

SEQ ID NO: 2077 - DNA, 495 bp, Artificial Sequence
  Oligonucleotide
gcctccctcgcgccatcagcgttacttcaagtcacccaggacagaggacgctgggcccagagaaaggaggcagaaggaaagccatcttacctgaagagacggtgaccattgtcccttggccccagatatcaaaaggtcgaccgttacttcaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacccgttacttcaagtcacctgagcgggctggcaaggc

SEQ ID NO: 2078 - DNA, 495 bp, Artificial Sequence
  Oligonucleotide
gcctccctcgcgccatcagcgttacttctgcaatcccaggacagaggacgctgggcccagagaaaggaggcagaaggaaagccatcttacctgaagagacggtgaccattgtcccttggccccagatatcaaaaggtcgaccgttacttctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacacccgttacttctgcaatcctgagcgggctggcaaggc

SEQ ID NO: 2079 - DNA, 495 bp, Artificial Sequence
  Oligonucleotide
gcctccctcgcgccatcagcgttacttatcgacgaccaggacagaggacgctgggcccagagaaaggaggcagaaggaaagccatcttacctgaagagacggtgaccattgtcccttggccccagatatcaaaaggtcgaccgttacttatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacacccgttacttatcgacgactgagcgggctggcaaggc

SEQ ID NO: 2080 - DNA, 495 bp, Artificial Sequence
  Oligonucleotide
gcctccctcgcgccatcagcgttacttacagactgccaggacagaggacgctgggcccagagaaaggaggcagaaggaaagccatcttacctgaagagacggtgaccattgtcccttggccccagatatcaaaaggtcgaccgttacttacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaacgttacttacagactgctgagcgggctggcaaggc

SEQ ID NO: 2081 - DNA, 495 bp, Artificial Sequence
  Oligonucleotide
gcctccctcgcgccatcagcgttacttccttatagccaggacagaggacgctgggcccagagaaaggaggcagaaggaaagccatcttacctgaagagacggtgaccattgtcccttggccccagatatcaaaaggtcgaccgttacttccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggaccgttacttccttatagctgagcgggctggcaaggc

SEQ ID NO: 2082 - DNA, 495 bp, Artificial Sequence
  Oligonucleotide
gcctccctcgcgccatcagcgttactttacgcgttccaggacagaggacgctgggcccagagaaaggaggcagaaggaaagccatcttacctgaagagacggtgaccattgtcccttggccccagatatcaaaaggtcgaccgttactttacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacacccgttactttacgcgttctgagcgggctggcaaggc

SEQ ID NO: 2083 - DNA, 495 bp, Artificial Sequence
  Oligonucleotide
gcctccctcgcgccatcagcgttacttctataaggccaggacagaggacgctgggcccagagaaaggaggcagaaggaaagccatcttacctgaagagacggtgaccattgtcccttggccccagatatcaaaaggtcgaccgttacttctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgcgttacttctataaggctgagcgggctggcaaggc

SEQ ID NO: 2084 - DNA, 495 bp, Artificial Sequence
  Oligonucleotide
gcctccctcgcgccatcagcgttactttcttagtcccaggacagaggacgctgggcccagagaaaggaggcagaaggaaagccatcttacctgaagagacggtgaccattgtcccttggccccagatatcaaaaggtcgaccgttactttcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgccgttactttcttagtcctgagcgggctggcaaggc

SEQ ID NO: 2085 - DNA, 495 bp, Artificial Sequence
  Oligonucleotide
gcctccctcgcgccatcagcgttactttgtctgcaccaggacagaggacgctgggcccagagaaaggaggcagaaggaaagccatcttacctgaagagacggtgaccattgtcccttggccccagatatcaaaaggtcgaccgttactttgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacacccgttactttgtctgcactgagcgggctggcaaggc

SEQ ID NO: 2086 - DNA, 495 bp, Artificial Sequence
  Oligonucleotide
gcctccctcgcgccatcagcgttacttgccattaaccaggacagaggacgctgggcccagagaaaggaggcagaaggaaagccatcttacctgaagagacggtgaccattgtcccttggccccagatatcaaaaggtcgaccgttacttgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgccgttacttgccattaactgagcgggctggcaaggc

SEQ ID NO: 2087 - DNA, 495 bp, Artificial Sequence
  Oligonucleotide
gcctccctcgcgccatcagcgttacttgactaagaccaggacagaggacgctgggcccagagaaaggaggcagaaggaaagccatcttacctgaagagacggtgaccattgtcccttggccccagatatcaaaaggtcgaccgttacttgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgcgttacttgactaagactgagcgggctggcaaggc

SEQ ID NO: 2088 - DNA, 495 bp, Artificial Sequence
  Oligonucleotide
gcctccctcgcgccatcagcgttacttaggttgctccaggacagaggacgctgggcccagagaaaggaggcagaaggaaagccatcttacctgaagagacggtgaccattgtcccttggccccagatatcaaaaggtcgaccgttacttaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgcgttacttaggttgctctgagcgggctggcaaggc

SEQ ID NO: 2089 - DNA, 495 bp, Artificial Sequence
  Oligonucleotide
gcctccctcgcgccatcagcgttacttctcgagaaccaggacagaggacgctgggcccagagaaaggaggcagaaggaaagccatcttacctgaagagacggtgaccattgtcccttggccccagatatcaaaaggtcgaccgttacttctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacacccgttacttctcgagaactgagcgggctggcaaggc

SEQ ID NO: 2090 - DNA, 495 bp, Artificial Sequence
  Oligonucleotide
gcctccctcgcgccatcagcgttacttttaatggcccaggacagaggacgctgggcccagagaaaggaggcagaaggaaagccatcttacctgaagagacggtgaccattgtcccttggccccagatatcaaaaggtcgaccgttacttttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacacccgttacttttaatggcctgagcgggctggcaaggc

SEQ ID NO: 2091 - DNA, 495 bp, Artificial Sequence
  Oligonucleotide
gcctccctcgcgccatcagcgttactttgcagacaccaggacagaggacgctgggcccagagaaaggaggcagaaggaaagccatcttacctgaagagacggtgaccattgtcccttggccccagatatcaaaaggtcgaccgttactttgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaacgttactttgcagacactgagcgggctggcaaggc

SEQ ID NO: 2092 - DNA, 495 bp, Artificial Sequence
  Oligonucleotide
gcctccctcgcgccatcagcgttactttcactgagccaggacagaggacgctgggcccagagaaaggaggcagaaggaaagccatcttacctgaagagacggtgaccattgtcccttggccccagatatcaaaaggtcgaccgttactttcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtcgttactttcactgagctgagcgggctggcaaggc

SEQ ID NO: 2093 - DNA, 495 bp, Artificial Sequence
  Oligonucleotide
gcctccctcgcgccatcagcgttacttgagtacgtccaggacagaggacgctgggcccagagaaaggaggcagaaggaaagccatcttacctgaagagacggtgaccattgtcccttggccccagatatcaaaaggtcgaccgttacttgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccaccgttacttgagtacgtctgagcgggctggcaaggc

SEQ ID NO: 2094 - DNA, 495 bp, Artificial Sequence
  Oligonucleotide
gcctccctcgcgccatcagcgttacttatacgccaccaggacagaggacgctgggcccagagaaaggaggcagaaggaaagccatcttacctgaagagacggtgaccattgtcccttggccccagatatcaaaaggtcgaccgttacttatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggaccgttacttatacgccactgagcgggctggcaaggc

SEQ ID NO: 2095 - DNA, 495 bp, Artificial Sequence
  Oligonucleotide
gcctccctcgcgccatcagcgttactttcgcatcaccaggacagaggacgctgggcccagagaaaggaggcagaaggaaagccatcttacctgaagagacggtgaccattgtcccttggccccagatatcaaaaggtcgaccgttactttcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggaccgttactttcgcatcactgagcgggctggcaaggc

SEQ ID NO: 2096 - DNA, 495 bp, Artificial Sequence
  Oligonucleotide
gcctccctcgcgccatcagcgttacttcgcttaatccaggacagaggacgctgggcccagagaaaggaggcagaaggaaagccatcttacctgaagagacggtgaccattgtcccttggccccagatatcaaaaggtcgaccgttacttcgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggaccgttacttcgcttaatctgagcgggctggcaaggc

SEQ ID NO: 2097 - DNA, 495 bp, Artificial Sequence
  Oligonucleotide
gcctccctcgcgccatcagcgttactttggttatcccaggacagaggacgctgggcccagagaaaggaggcagaaggaaagccatcttacctgaagagacggtgaccattgtcccttggccccagatatcaaaaggtcgaccgttactttggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtcgttactttggttatcctgagcgggctggcaaggc

SEQ ID NO: 2098 - DNA, 495 bp, Artificial Sequence
  Oligonucleotide
gcctccctcgcgccatcagcgttacttggattgctccaggacagaggacgctgggcccagagaaaggaggcagaaggaaagccatcttacctgaagagacggtgaccattgtcccttggccccagatatcaaaaggtcgaccgttacttggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggaccgttacttggattgctctgagcgggctggcaaggc

SEQ ID NO: 2099 - DNA, 495 bp, Artificial Sequence
  Oligonucleotide
gcctccctcgcgccatcagcgttacttctcagtgaccaggacagaggacgctgggcccagagaaaggaggcagaaggaaagccatcttacctgaagagacggtgaccattgtcccttggccccagatatcaaaaggtcgaccgttacttctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtcgttacttctcagtgactgagcgggctggcaaggc

SEQ ID NO: 2100 - DNA, 495 bp, Artificial Sequence
  Oligonucleotide
gcctccctcgcgccatcagcgttacttacgtactcccaggacagaggacgctgggcccagagaaaggaggcagaaggaaagccatcttacctgaagagacggtgaccattgtcccttggccccagatatcaaaaggtcgaccgttacttacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggaccgttacttacgtactcctgagcgggctggcaaggc

SEQ ID NO: 2101 - DNA, 495 bp, Artificial Sequence
  Oligonucleotide
gcctccctcgcgccatcagcgttactttgatgcgaccaggacagaggacgctgggcccagagaaaggaggcagaaggaaagccatcttacctgaagagacggtgaccattgtcccttggccccagatatcaaaaggtcgaccgttactttgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggacccccgttactttgatgcgactgagcgggctggcaaggc

SEQ ID NO: 2102 - DNA, 495 bp, Artificial Sequence
  Oligonucleotide
gcctccctcgcgccatcagcgttacttattaagcgccaggacagaggacgctgggcccagagaaaggaggcagaaggaaagccatcttacctgaagagacggtgaccattgtcccttggccccagatatcaaaaggtcgaccgttacttattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactcccgttacttattaagcgctgagcgggctggcaaggc

SEQ ID NO: 2103 - DNA, 495 bp, Artificial Sequence
  Oligonucleotide
gcctccctcgcgccatcagcgttacttagcaatccccaggacagaggacgctgggcccagagaaaggaggcagaaggaaagccatcttacctgaagagacggtgaccattgtcccttggccccagatatcaaaaggtcgaccgttacttagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactcccgttacttagcaatccctgagcgggctggcaaggc

SEQ ID NO: 2104 - DNA, 495 bp, Artificial Sequence
  Oligonucleotide
gcctccctcgcgccatcagcgttacttgcttagtaccaggacagaggacgctgggcccagagaaaggaggcagaaggaaagccatcttacctgaagagacggtgaccattgtcccttggccccagatatcaaaaggtcgaccgttacttgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgacgttacttgcttagtactgagcgggctggcaaggc

SEQ ID NO: 2105 - DNA, 495 bp, Artificial Sequence
  Oligonucleotide
gcctccctcgcgccatcagcgttactttgaccttgccaggacagaggacgctgggcccagagaaaggaggcagaaggaaagccatcttacctgaagagacggtgaccattgtcccttggccccagatatcaaaaggtcgaccgttactttgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcacccgttactttgaccttgctgagcgggctggcaaggc

SEQ ID NO: 2106 - DNA, 495 bp, Artificial Sequence
  Oligonucleotide
gcctccctcgcgccatcagcgttacttcaaggtcaccaggacagaggacgctgggcccagagaaaggaggcagaaggaaagccatcttacctgaagagacggtgaccattgtcccttggccccagatatcaaaaggtcgaccgttacttcaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtacccgttacttcaaggtcactgagcgggctggcaaggc

SEQ ID NO: 2107 - DNA, 495 bp, Artificial Sequence
  Oligonucleotide
gcctccctcgcgccatcagcgttacttcactgtacccaggacagaggacgctgggcccagagaaaggaggcagaaggaaagccatcttacctgaagagacggtgaccattgtcccttggccccagatatcaaaaggtcgaccgttacttcactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttccgttacttcactgtacctgagcgggctggcaaggc

SEQ ID NO: 2108 - DNA, 495 bp, Artificial Sequence
  Oligonucleotide
gcctccctcgcgccatcagcgttacttgatgatccccaggacagaggacgctgggcccagagaaaggaggcagaaggaaagccatcttacctgaagagacggtgaccattgtcccttggccccagatatcaaaaggtcgaccgttacttgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggcgttacttgatgatccctgagcgggctggcaaggc

SEQ ID NO: 2109 - DNA, 495 bp, Artificial Sequence
  Oligonucleotide
gcctccctcgcgccatcagcgttacttcgccaataccaggacagaggacgctgggcccagagaaaggaggcagaaggaaagccatcttacctgaagagacggtgaccattgtcccttggccccagatatcaaaaggtcgaccgttacttcgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggcgttacttcgccaatactgagcgggctggcaaggc

SEQ ID NO: 2110 - DNA, 495 bp, Artificial Sequence
  Oligonucleotide
gcctccctcgcgccatcagcgttactttcaagcctccaggacagaggacgctgggcccagagaaaggaggcagaaggaaagccatcttacctgaagagacggtgaccattgtcccttggccccagatatcaaaaggtcgaccgttactttcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacacgttactttcaagcctctgagcgggctggcaaggc

SEQ ID NO: 2111 - DNA, 495 bp, Artificial Sequence
  Oligonucleotide
gcctccctcgcgccatcagcgttacttacgtgtgtccaggacagaggacgctgggcccagagaaaggaggcagaaggaaagccatcttacctgaagagacggtgaccattgtcccttggccccagatatcaaaaggtcgaccgttacttacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagcgttacttacgtgtgtctgagcgggctggcaaggc

SEQ ID NO: 2112 - DNA, 495 bp, Artificial Sequence
  Oligonucleotide
gcctccctcgcgccatcagcgttactttccgtctaccaggacagaggacgctgggcccagagaaaggaggcagaaggaaagccatcttacctgaagagacggtgaccattgtcccttggccccagatatcaaaaggtcgaccgttactttccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagcgttactttccgtctactgagcgggctggcaaggc

SEQ ID NO: 2113 - DNA, 495 bp, Artificial Sequence
  Oligonucleotide
gcctccctcgcgccatcagcgttacttaagagctgccaggacagaggacgctgggcccagagaaaggaggcagaaggaaagccatcttacctgaagagacggtgaccattgtcccttggccccagatatcaaaaggtcgaccgttacttaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgcgttacttaagagctgctgagcgggctggcaaggc

SEQ ID NO: 2114 - DNA, 495 bp, Artificial Sequence
  Oligonucleotide
gcctccctcgcgccatcagcgttactttatcgctcccaggacagaggacgctgggcccagagaaaggaggcagaaggaaagccatcttacctgaagagacggtgaccattgtcccttggccccagatatcaaaaggtcgaccgttactttatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagcgttactttatcgctcctgagcgggctggcaaggc

SEQ ID NO: 2115 - DNA, 495 bp, Artificial Sequence
  Oligonucleotide
gcctccctcgcgccatcagcgttactttcagatgcccaggacagaggacgctgggcccagagaaaggaggcagaaggaaagccatcttacctgaagagacggtgaccattgtcccttggccccagatatcaaaaggtcgaccgttactttcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaaccccgttactttcagatgcctgagcgggctggcaaggc

SEQ ID NO: 2116 - DNA, 495 bp, Artificial Sequence
  Oligonucleotide
gcctccctcgcgccatcagcgttacttgtgtagcaccaggacagaggacgctgggcccagagaaaggaggcagaaggaaagccatcttacctgaagagacggtgaccattgtcccttggccccagatatcaaaaggtcgaccgttacttgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgcgttacttgtgtagcactgagcgggctggcaaggc

SEQ ID NO: 2117 - DNA, 495 bp, Artificial Sequence
  Oligonucleotide
gcctccctcgcgccatcagcgttactttggcagttccaggacagaggacgctgggcccagagaaaggaggcagaaggaaagccatcttacctgaagagacggtgaccattgtcccttggccccagatatcaaaaggtcgaccgttactttggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgcgttactttggcagttctgagcgggctggcaaggc

SEQ ID NO: 2118 - DNA, 495 bp, Artificial Sequence
  Oligonucleotide
gcctccctcgcgccatcagcgttacttcagtccaaccaggacagaggacgctgggcccagagaaaggaggcagaaggaaagccatcttacctgaagagacggtgaccattgtcccttggccccagatatcaaaaggtcgaccgttacttcagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcaccgttacttcagtccaactgagcgggctggcaaggc

SEQ ID NO: 2119 - DNA, 495 bp, Artificial Sequence
  Oligonucleotide
gcctccctcgcgccatcagcgttacttgtgtctacccaggacagaggacgctgggcccagagaaaggaggcagaaggaaagccatcttacctgaagagacggtgaccattgtcccttggccccagatatcaaaaggtcgaccgttacttgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggcgttacttgtgtctacctgagcgggctggcaaggc

SEQ ID NO: 2120 - DNA, 495 bp, Artificial Sequence
  Oligonucleotide
gcctccctcgcgccatcagcgttacttgtacagtgccaggacagaggacgctgggcccagagaaaggaggcagaaggaaagccatcttacctgaagagacggtgaccattgtcccttggccccagatatcaaaaggtcgaccgttacttgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagcgttacttgtacagtgctgagcgggctggcaaggc

SEQ ID NO: 2121 - DNA, 495 bp, Artificial Sequence
  Oligonucleotide
gcctccctcgcgccatcagcgttacttggatcatcccaggacagaggacgctgggcccagagaaaggaggcagaaggaaagccatcttacctgaagagacggtgaccattgtcccttggccccagatatcaaaaggtcgaccgttacttggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagcgttacttggatcatcctgagcgggctggcaaggc

SEQ ID NO: 2122 - DNA, 495 bp, Artificial Sequence
  Oligonucleotide
gcctccctcgcgccatcagcgttactttattggcgccaggacagaggacgctgggcccagagaaaggaggcagaaggaaagccatcttacctgaagagacggtgaccattgtcccttggccccagatatcaaaaggtcgaccgttactttattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcacgttactttattggcgctgagcgggctggcaaggc

SEQ ID NO: 2123 - DNA, 495 bp, Artificial Sequence
  Oligonucleotide
gcctccctcgcgccatcagcgttacttaggcttgaccaggacagaggacgctgggcccagagaaaggaggcagaaggaaagccatcttacctgaagagacggtgaccattgtcccttggccccagatatcaaaaggtcgaccgttacttaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcaccgttacttaggcttgactgagcgggctggcaaggc

SEQ ID NO: 2124 - DNA, 495 bp, Artificial Sequence
  Oligonucleotide
gcctccctcgcgccatcagcgttacttacacacgtccaggacagaggacgctgggcccagagaaaggaggcagaaggaaagccatcttacctgaagagacggtgaccattgtcccttggccccagatatcaaaaggtcgaccgttacttacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatcgttacttacacacgtctgagcgggctggcaaggc

SEQ ID NO: 2125 - DNA, 495 bp, Artificial Sequence
  Oligonucleotide
gcctccctcgcgccatcagcgttactttagacggaccaggacagaggacgctgggcccagagaaaggaggcagaaggaaagccatcttacctgaagagacggtgaccattgtcccttggccccagatatcaaaaggtcgaccgttactttagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgacgttactttagacggactgagcgggctggcaaggc

SEQ ID NO: 2126 - DNA, 495 bp, Artificial Sequence
  Oligonucleotide
gcctccctcgcgccatcagcgttacttgagcgataccaggacagaggacgctgggcccagagaaaggaggcagaaggaaagccatcttacctgaagagacggtgaccattgtcccttggccccagatatcaaaaggtcgaccgttacttgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttcgttacttgagcgatactgagcgggctggcaaggc

SEQ ID NO: 2127 - DNA, 495 bp, Artificial Sequence
  Oligonucleotide
gcctccctcgcgccatcagcgttacttgcatctgaccaggacagaggacgctgggcccagagaaaggaggcagaaggaaagccatcttacctgaagagacggtgaccattgtcccttggccccagatatcaaaaggtcgaccgttacttgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacacgttacttgcatctgactgagcgggctggcaaggc

SEQ ID NO: 2128 - DNA, 495 bp, Artificial Sequence
  Oligonucleotide
gcctccctcgcgccatcagcgttactttgctacacccaggacagaggacgctgggcccagagaaaggaggcagaaggaaagccatcttacctgaagagacggtgaccattgtcccttggccccagatatcaaaaggtcgaccgttactttgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgcgttactttgctacacctgagcgggctggcaaggc

SEQ ID NO: 2129 - DNA, 495 bp, Artificial Sequence
  Oligonucleotide
gcctccctcgcgccatcagcgttacttaactgccaccaggacagaggacgctgggcccagagaaaggaggcagaaggaaagccatcttacctgaagagacggtgaccattgtcccttggccccagatatcaaaaggtcgaccgttacttaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttcgttacttaactgccactgagcgggctggcaaggc

SEQ ID NO: 2130 - DNA, 495 bp, Artificial Sequence
  Oligonucleotide
gcctccctcgcgccatcagcgttacttttggactgccaggacagaggacgctgggcccagagaaaggaggcagaaggaaagccatcttacctgaagagacggtgaccattgtcccttggccccagatatcaaaaggtcgaccgttacttttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggcgttacttttggactgctgagcgggctggcaaggc

SEQ ID NO: 2131 - DNA, 495 bp, Artificial Sequence
  Oligonucleotide
gcctccctcgcgccatcagcgttactttcggtactccaggacagaggacgctgggcccagagaaaggaggcagaaggaaagccatcttacctgaagagacggtgaccattgtcccttggccccagatatcaaaaggtcgaccgttactttcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgcgttactttcggtactctgagcgggctggcaaggc

SEQ ID NO: 2132 - DNA, 495 bp, Artificial Sequence
  Oligonucleotide
gcctccctcgcgccatcagcgttacttccatggatccaggacagaggacgctgggcccagagaaaggaggcagaaggaaagccatcttacctgaagagacggtgaccattgtcccttggccccagatatcaaaaggtcgaccgttacttccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggataccgttacttccatggatctgagcgggctggcaaggc

SEQ ID NO: 2133 - DNA, 495 bp, Artificial Sequence
  Oligonucleotide
gcctccctcgcgccatcagcgttacttacgaagatccaggacagaggacgctgggcccagagaaaggaggcagaaggaaagccatcttacctgaagagacggtgaccattgtcccttggccccagatatcaaaaggtcgaccgttacttacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaacgttacttacgaagatctgagcgggctggcaaggc

SEQ ID NO: 2134 - DNA, 495 bp, Artificial Sequence
  Oligonucleotide
gcctccctcgcgccatcagcgttacttactgtggaccaggacagaggacgctgggcccagagaaaggaggcagaaggaaagccatcttacctgaagagacggtgaccattgtcccttggccccagatatcaaaaggtcgaccgttacttactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttcgttacttactgtggactgagcgggctggcaaggc

SEQ ID NO: 2135 - DNA, 495 bp, Artificial Sequence
  Oligonucleotide
gcctccctcgcgccatcagcgttacttggtgtcatccaggacagaggacgctgggcccagagaaaggaggcagaaggaaagccatcttacctgaagagacggtgaccattgtcccttggccccagatatcaaaaggtcgaccgttacttggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctcgttacttggtgtcatctgagcgggctggcaaggc

SEQ ID NO: 2136 - DNA, 495 bp, Artificial Sequence
  Oligonucleotide
gcctccctcgcgccatcagcgttactttcgtgaagccaggacagaggacgctgggcccagagaaaggaggcagaaggaaagccatcttacctgaagagacggtgaccattgtcccttggccccagatatcaaaaggtcgaccgttactttcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggcgttactttcgtgaagctgagcgggctggcaaggc

SEQ ID NO: 2137 - DNA, 495 bp, Artificial Sequence
  Oligonucleotide
gcctccctcgcgccatcagcgttacttcactagctccaggacagaggacgctgggcccagagaaaggaggcagaaggaaagccatcttacctgaagagacggtgaccattgtcccttggccccagatatcaaaaggtcgaccgttacttcactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaacgttacttcactagctctgagcgggctggcaaggc

SEQ ID NO: 2138 - DNA, 495 bp, Artificial Sequence
  Oligonucleotide
gcctccctcgcgccatcagcgttacttggtcaactccaggacagaggacgctgggcccagagaaaggaggcagaaggaaagccatcttacctgaagagacggtgaccattgtcccttggccccagatatcaaaaggtcgaccgttacttggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggacgttacttggtcaactctgagcgggctggcaaggc

SEQ ID NO: 2139 - DNA, 495 bp, Artificial Sequence
  Oligonucleotide
gcctccctcgcgccatcagcgttactttacgtacgccaggacagaggacgctgggcccagagaaaggaggcagaaggaaagccatcttacctgaagagacggtgaccattgtcccttggccccagatatcaaaaggtcgaccgttactttacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatccgttactttacgtacgctgagcgggctggcaaggc

SEQ ID NO: 2140 - DNA, 495 bp, Artificial Sequence
  Oligonucleotide
gcctccctcgcgccatcagcgttacttatgacaccccaggacagaggacgctgggcccagagaaaggaggcagaaggaaagccatcttacctgaagagacggtgaccattgtcccttggccccagatatcaaaaggtcgaccgttacttatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggcgttacttatgacaccctgagcgggctggcaaggc

SEQ ID NO: 2141 - DNA, 495 bp, Artificial Sequence
  Oligonucleotide
gcctccctcgcgccatcagcgttacttcttcacgaccaggacagaggacgctgggcccagagaaaggaggcagaaggaaagccatcttacctgaagagacggtgaccattgtcccttggccccagatatcaaaaggtcgaccgttacttcttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacaccgttacttcttcacgactgagcgggctggcaaggc

SEQ ID NO: 2142 - DNA, 495 bp, Artificial Sequence
  Oligonucleotide
gcctccctcgcgccatcagcgttacttagaatcagccaggacagaggacgctgggcccagagaaaggaggcagaaggaaagccatcttacctgaagagacggtgaccattgtcccttggccccagatatcaaaaggtcgaccgttacttagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacacccgttacttagaatcagctgagcgggctggcaaggc

SEQ ID NO: 2143 - DNA, 495 bp, Artificial Sequence
  Oligonucleotide
gcctccctcgcgccatcagcgttacttagttatgcccaggacagaggacgctgggcccagagaaaggaggcagaaggaaagccatcttacctgaagagacggtgaccattgtcccttggccccagatatcaaaaggtcgaccgttacttagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataacgttacttagttatgcctgagcgggctggcaaggc

SEQ ID NO: 2144 - DNA, 495 bp, Artificial Sequence
  Oligonucleotide
gcctccctcgcgccatcagcgttacttaggtctcaccaggacagaggacgctgggcccagagaaaggaggcagaaggaaagccatcttacctgaagagacggtgaccattgtcccttggccccagatatcaaaaggtcgaccgttacttaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacacccgttacttaggtctcactgagcgggctggcaaggc

SEQ ID NO: 2145 - DNA, 495 bp, Artificial Sequence
  Oligonucleotide
gcctccctcgcgccatcagcgttacttgtcatagtccaggacagaggacgctgggcccagagaaaggaggcagaaggaaagccatcttacctgaagagacggtgaccattgtcccttggccccagatatcaaaaggtcgaccgttacttgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtcgttacttgtcatagtctgagcgggctggcaaggc

SEQ ID NO: 2146 - DNA, 495 bp, Artificial Sequence
  Oligonucleotide
gcctccctcgcgccatcagcgttacttgtgacttgccaggacagaggacgctgggcccagagaaaggaggcagaaggaaagccatcttacctgaagagacggtgaccattgtcccttggccccagatatcaaaaggtcgaccgttacttgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgcgttacttgtgacttgctgagcgggctggcaaggc

SEQ ID NO: 2147 - DNA, 495 bp, Artificial Sequence
  Oligonucleotide
gcctccctcgcgccatcagcgttacttgattgcagccaggacagaggacgctgggcccagagaaaggaggcagaaggaaagccatcttacctgaagagacggtgaccattgtcccttggccccagatatcaaaaggtcgaccgttacttgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggatacccgttacttgattgcagctgagcgggctggcaaggc

SEQ ID NO: 2148 - DNA, 495 bp, Artificial Sequence
  Oligonucleotide
gcctccctcgcgccatcagcgttacttactatgacccaggacagaggacgctgggcccagagaaaggaggcagaaggaaagccatcttacctgaagagacggtgaccattgtcccttggccccagatatcaaaaggtcgaccgttacttactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaaccgttacttactatgacctgagcgggctggcaaggc

SEQ ID NO: 2149 - DNA, 495 bp, Artificial Sequence
  Oligonucleotide
gcctccctcgcgccatcagcgttacttatggtcaaccaggacagaggacgctgggcccagagaaaggaggcagaaggaaagccatcttacctgaagagacggtgaccattgtcccttggccccagatatcaaaaggtcgaccgttacttatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagaccgttacttatggtcaactgagcgggctggcaaggc

SEQ ID NO: 2150 - DNA, 495 bp, Artificial Sequence
  Oligonucleotide
gcctccctcgcgccatcagcgttacttgatggcttccaggacagaggacgctgggcccagagaaaggaggcagaaggaaagccatcttacctgaagagacggtgaccattgtcccttggccccagatatcaaaaggtcgaccgttacttgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaaccgttacttgatggcttctgagcgggctggcaaggc

SEQ ID NO: 2151 - DNA, 495 bp, Artificial Sequence
  Oligonucleotide
gcctccctcgcgccatcagcgttacttagcatatgccaggacagaggacgctgggcccagagaaaggaggcagaaggaaagccatcttacctgaagagacggtgaccattgtcccttggccccagatatcaaaaggtcgaccgttacttagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagaccgttacttagcatatgctgagcgggctggcaaggc

SEQ ID NO: 2152 - DNA, 495 bp, Artificial Sequence
  Oligonucleotide
gcctccctcgcgccatcagcgttacttcatatgctccaggacagaggacgctgggcccagagaaaggaggcagaaggaaagccatcttacctgaagagacggtgaccattgtcccttggccccagatatcaaaaggtcgaccgttacttcatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgcgttacttcatatgctctgagcgggctggcaaggc

SEQ ID NO: 2153 - DNA, 495 bp, Artificial Sequence
  Oligonucleotide
gcctccctcgcgccatcagcgttactttcgtcgatccaggacagaggacgctgggcccagagaaaggaggcagaaggaaagccatcttacctgaagagacggtgaccattgtcccttggccccagatatcaaaaggtcgaccgttactttcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacacccgttactttcgtcgatctgagcgggctggcaaggc

SEQ ID NO: 2154 - DNA, 495 bp, Artificial Sequence
  Oligonucleotide
gcctccctcgcgccatcagcgttacttcagtctgtccaggacagaggacgctgggcccagagaaaggaggcagaaggaaagccatcttacctgaagagacggtgaccattgtcccttggccccagatatcaaaaggtcgaccgttacttcagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgccgttacttcagtctgtctgagcgggctggcaaggc

SEQ ID NO: 2155 - DNA, 495 bp, Artificial Sequence
  Oligonucleotide
gcctccctcgcgccatcagcgttacttaacgcgtaccaggacagaggacgctgggcccagagaaaggaggcagaaggaaagccatcttacctgaagagacggtgaccattgtcccttggccccagatatcaaaaggtcgaccgttacttaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgcgttacttaacgcgtactgagcgggctggcaaggc

SEQ ID NO: 2156 - DNA, 495 bp, Artificial Sequence
  Oligonucleotide
gcctccctcgcgccatcagcgttacttgtagttcgccaggacagaggacgctgggcccagagaaaggaggcagaaggaaagccatcttacctgaagagacggtgaccattgtcccttggccccagatatcaaaaggtcgaccgttacttgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgccgttacttgtagttcgctgagcgggctggcaaggc

SEQ ID NO: 2157 - DNA, 495 bp, Artificial Sequence
  Oligonucleotide
gcctccctcgcgccatcagcgttacttcgaactacccaggacagaggacgctgggcccagagaaaggaggcagaaggaaagccatcttacctgaagagacggtgaccattgtcccttggccccagatatcaaaaggtcgaccgttacttcgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagaccgttacttcgaactacctgagcgggctggcaaggc

SEQ ID NO: 2158 - DNA, 495 bp, Artificial Sequence
  Oligonucleotide
gcctccctcgcgccatcagcgttacttttaacgtcccaggacagaggacgctgggcccagagaaaggaggcagaaggaaagccatcttacctgaagagacggtgaccattgtcccttggccccagatatcaaaaggtcgaccgttacttttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacacccgttacttttaacgtcctgagcgggctggcaaggc

SEQ ID NO: 2159 - DNA, 495 bp, Artificial Sequence
  Oligonucleotide
gcctccctcgcgccatcagcgttacttagcaacctccaggacagaggacgctgggcccagagaaaggaggcagaaggaaagccatcttacctgaagagacggtgaccattgtcccttggccccagatatcaaaaggtcgaccgttacttagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggaccgttacttagcaacctctgagcgggctggcaaggc

SEQ ID NO: 2160 - DNA, 495 bp, Artificial Sequence
  Oligonucleotide
gcctccctcgcgccatcagcgttacttttctcgagccaggacagaggacgctgggcccagagaaaggaggcagaaggaaagccatcttacctgaagagacggtgaccattgtcccttggccccagatatcaaaaggtcgaccgttacttttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttcgttacttttctcgagctgagcgggctggcaaggc

SEQ ID NO: 2161 - DNA, 495 bp, Artificial Sequence
  Oligonucleotide
gcctccctcgcgccatcagcgttacttactctacgccaggacagaggacgctgggcccagagaaaggaggcagaaggaaagccatcttacctgaagagacggtgaccattgtcccttggccccagatatcaaaaggtcgaccgttacttactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggaccgttacttactctacgctgagcgggctggcaaggc

SEQ ID NO: 2162 - DNA, 495 bp, Artificial Sequence
  Oligonucleotide
gcctccctcgcgccatcagcgttactttaccggaaccaggacagaggacgctgggcccagagaaaggaggcagaaggaaagccatcttacctgaagagacggtgaccattgtcccttggccccagatatcaaaaggtcgaccgttactttaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacacccgttactttaccggaactgagcgggctggcaaggc

SEQ ID NO: 2163 - DNA, 495 bp, Artificial Sequence
  Oligonucleotide
gcctccctcgcgccatcagcgttacttcgaattgcccaggacagaggacgctgggcccagagaaaggaggcagaaggaaagccatcttacctgaagagacggtgaccattgtcccttggccccagatatcaaaaggtcgaccgttacttcgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaaccgttacttcgaattgcctgagcgggctggcaaggc

SEQ ID NO: 2164 - DNA, 495 bp, Artificial Sequence
  Oligonucleotide
gcctccctcgcgccatcagcgttacttttcgctcaccaggacagaggacgctgggcccagagaaaggaggcagaaggaaagccatcttacctgaagagacggtgaccattgtcccttggccccagatatcaaaaggtcgaccgttacttttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacacgttacttttcgctcactgagcgggctggcaaggc

SEQ ID NO: 2165 - DNA, 495 bp, Artificial Sequence
  Oligonucleotide
gcctccctcgcgccatcagcgttacttgacgttaaccaggacagaggacgctgggcccagagaaaggaggcagaaggaaagccatcttacctgaagagacggtgaccattgtcccttggccccagatatcaaaaggtcgaccgttacttgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgcgttacttgacgttaactgagcgggctggcaaggc

SEQ ID NO: 2166 - DNA, 495 bp, Artificial Sequence
  Oligonucleotide
gcctccctcgcgccatcagcgttacttcgtagagtccaggacagaggacgctgggcccagagaaaggaggcagaaggaaagccatcttacctgaagagacggtgaccattgtcccttggccccagatatcaaaaggtcgaccgttacttcgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgccgttacttcgtagagtctgagcgggctggcaaggc

SEQ ID NO: 2167 - DNA, 495 bp, Artificial Sequence
  Oligonucleotide
gcctccctcgcgccatcagcgttacttttccggtaccaggacagaggacgctgggcccagagaaaggaggcagaaggaaagccatcttacctgaagagacggtgaccattgtcccttggccccagatatcaaaaggtcgaccgttacttttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgccgttacttttccggtactgagcgggctggcaaggc

SEQ ID NO: 2168 - DNA, 495 bp, Artificial Sequence
  Oligonucleotide
gcctccctcgcgccatcagcgttacttgcaattcgccaggacagaggacgctgggcccagagaaaggaggcagaaggaaagccatcttacctgaagagacggtgaccattgtcccttggccccagatatcaaaaggtcgaccgttacttgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacaccgttacttgcaattcgctgagcgggctggcaaggc

SEQ ID NO: 2169 - DNA, 495 bp, Artificial Sequence
  Oligonucleotide
gcctccctcgcgccatcagcgttactttgagcgaaccaggacagaggacgctgggcccagagaaaggaggcagaaggaaagccatcttacctgaagagacggtgaccattgtcccttggccccagatatcaaaaggtcgaccgttactttgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgccgttactttgagcgaactgagcgggctggcaaggc

SEQ ID NO: 2170 - DNA, 495 bp, Artificial Sequence
  Oligonucleotide
gcctccctcgcgccatcagcgttactttactaagcccaggacagaggacgctgggcccagagaaaggaggcagaaggaaagccatcttacctgaagagacggtgaccattgtcccttggccccagatatcaaaaggtcgaccgttactttactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggacccccgttactttactaagcctgagcgggctggcaaggc

SEQ ID NO: 2171 - DNA, 495 bp, Artificial Sequence
  Oligonucleotide
gcctccctcgcgccatcagcgttactttggcgtatccaggacagaggacgctgggcccagagaaaggaggcagaaggaaagccatcttacctgaagagacggtgaccattgtcccttggccccagatatcaaaaggtcgaccgttactttggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtcgttactttggcgtatctgagcgggctggcaaggc

SEQ ID NO: 2172 - DNA, 495 bp, Artificial Sequence
  Oligonucleotide
gcctccctcgcgccatcagcgttacttgataaccaccaggacagaggacgctgggcccagagaaaggaggcagaaggaaagccatcttacctgaagagacggtgaccattgtcccttggccccagatatcaaaaggtcgaccgttacttgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgcgttacttgataaccactgagcgggctggcaaggc

SEQ ID NO: 2173 - DNA, 495 bp, Artificial Sequence
  Oligonucleotide
gcctccctcgcgccatcagcgttacttctagtgaaccaggacagaggacgctgggcccagagaaaggaggcagaaggaaagccatcttacctgaagagacggtgaccattgtcccttggccccagatatcaaaaggtcgaccgttacttctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagcgttacttctagtgaactgagcgggctggcaaggc

SEQ ID NO: 2174 - DNA, 495 bp, Artificial Sequence
  Oligonucleotide
gcctccctcgcgccatcagcgttacttacgttcacccaggacagaggacgctgggcccagagaaaggaggcagaaggaaagccatcttacctgaagagacggtgaccattgtcccttggccccagatatcaaaaggtcgaccgttacttacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtcgttacttacgttcacctgagcgggctggcaaggc

SEQ ID NO: 2175 - DNA, 448 bp, Artificial Sequence
  Oligonucleotide
gcctccctcgcgccatcagcgttacttattacgctccaggacagaggacgctgggcccagagaaaggaggcagaaggaaagccatcttacctgaagagacggtgaccattgtcccttggccccagatatcaaaaggtcgaccgttacttattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcacgttacttattacgctctgagcgggctggcaaggc

SEQ ID NO: 2176 - DNA, 495 bp, Artificial Sequence
  Oligonucleotide
gcctccctcgcgccatcagcgttacttcattgagtccaggacagaggacgctgggcccagagaaaggaggcagaaggaaagccatcttacctgaagagacggtgaccattgtcccttggccccagatatcaaaaggtcgaccgttacttcattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcacccgttacttcattgagtctgagcgggctggcaaggc

SEQ ID NO: 2177 - DNA, 495 bp, Artificial Sequence
  Oligonucleotide
gcctccctcgcgccatcagtaggagaccttggttacagaaatgcagcaaaacccttcagagttaaagcaggagagaggttgtgaggactcacctgaggagacggtgaccagggttccctggccccagtagtcaaagtcgactaggagaccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcctaggagaccttggttactgagcgggctggcaaggc

SEQ ID NO: 2178 - DNA, 495 bp, Artificial Sequence
  Oligonucleotide
gcctccctcgcgccatcagtaggagacacctcttgcagaaatgcagcaaaacccttcagagttaaagcaggagagaggttgtgaggactcacctgaggagacggtgaccagggttccctggccccagtagtcaaagtcgactaggagacacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacctaggagacacctcttgctgagcgggctggcaaggc

SEQ ID NO: 2179 - DNA, 495 bp, Artificial Sequence
  Oligonucleotide
gcctccctcgcgccatcagtaggagacctgattctcagaaatgcagcaaaacccttcagagttaaagcaggagagaggttgtgaggactcacctgaggagacggtgaccagggttccctggccccagtagtcaaagtcgactaggagacctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcacctaggagacctgattctctgagcgggctggcaaggc

SEQ ID NO: 2180 - DNA, 495 bp, Artificial Sequence
  Oligonucleotide
gcctccctcgcgccatcagtaggagacagtaccgacagaaatgcagcaaaacccttcagagttaaagcaggagagaggttgtgaggactcacctgaggagacggtgaccagggttccctggccccagtagtcaaagtcgactaggagacagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcacctaggagacagtaccgactgagcgggctggcaaggc

SEQ ID NO: 2181 - DNA, 495 bp, Artificial Sequence
  Oligonucleotide
gcctccctcgcgccatcagtaggagacatccatggcagaaatgcagcaaaacccttcagagttaaagcaggagagaggttgtgaggactcacctgaggagacggtgaccagggttccctggccccagtagtcaaagtcgactaggagacatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgcctaggagacatccatggctgagcgggctggcaaggc

SEQ ID NO: 2182 - DNA, 495 bp, Artificial Sequence
  Oligonucleotide
gcctccctcgcgccatcagtaggagacgtagcagtcagaaatgcagcaaaacccttcagagttaaagcaggagagaggttgtgaggactcacctgaggagacggtgaccagggttccctggccccagtagtcaaagtcgactaggagacgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatctaggagacgtagcagtctgagcgggctggcaaggc

SEQ ID NO: 2183 - DNA, 495 bp, Artificial Sequence
  Oligonucleotide
gcctccctcgcgccatcagtaggagacatcttcgtcagaaatgcagcaaaacccttcagagttaaagcaggagagaggttgtgaggactcacctgaggagacggtgaccagggttccctggccccagtagtcaaagtcgactaggagacatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcacctaggagacatcttcgtctgagcgggctggcaaggc

SEQ ID NO: 2184 - DNA, 495 bp, Artificial Sequence
  Oligonucleotide
gcctccctcgcgccatcagtaggagactccacagtcagaaatgcagcaaaacccttcagagttaaagcaggagagaggttgtgaggactcacctgaggagacggtgaccagggttccctggccccagtagtcaaagtcgactaggagactccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcacctaggagactccacagtctgagcgggctggcaaggc

SEQ ID NO: 2185 - DNA, 495 bp, Artificial Sequence
  Oligonucleotide
gcctccctcgcgccatcagtaggagacagctagtgcagaaatgcagcaaaacccttcagagttaaagcaggagagaggttgtgaggactcacctgaggagacggtgaccagggttccctggccccagtagtcaaagtcgactaggagacagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacacctaggagacagctagtgctgagcgggctggcaaggc

SEQ ID NO: 2186 - DNA, 495 bp, Artificial Sequence
  Oligonucleotide
gcctccctcgcgccatcagtaggagactaaccaagcagaaatgcagcaaaacccttcagagttaaagcaggagagaggttgtgaggactcacctgaggagacggtgaccagggttccctggccccagtagtcaaagtcgactaggagactaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcacctaggagactaaccaagctgagcgggctggcaaggc

SEQ ID NO: 2187 - DNA, 495 bp, Artificial Sequence
  Oligonucleotide
gcctccctcgcgccatcagtaggagaccaagaggtcagaaatgcagcaaaacccttcagagttaaagcaggagagaggttgtgaggactcacctgaggagacggtgaccagggttccctggccccagtagtcaaagtcgactaggagaccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgcctaggagaccaagaggtctgagcgggctggcaaggc

SEQ ID NO: 2188 - DNA, 495 bp, Artificial Sequence
  Oligonucleotide
gcctccctcgcgccatcagtaggagacagttgacccagaaatgcagcaaaacccttcagagttaaagcaggagagaggttgtgaggactcacctgaggagacggtgaccagggttccctggccccagtagtcaaagtcgactaggagacagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaataggagacagttgaccctgagcgggctggcaaggc

SEQ ID NO: 2189 - DNA, 495 bp, Artificial Sequence
  Oligonucleotide
gcctccctcgcgccatcagtaggagaccagcatatcagaaatgcagcaaaacccttcagagttaaagcaggagagaggttgtgaggactcacctgaggagacggtgaccagggttccctggccccagtagtcaaagtcgactaggagaccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaataggagaccagcatatctgagcgggctggcaaggc

SEQ ID NO: 2190 - DNA, 495 bp, Artificial Sequence
  Oligonucleotide
gcctccctcgcgccatcagtaggagacgcaggattcagaaatgcagcaaaacccttcagagttaaagcaggagagaggttgtgaggactcacctgaggagacggtgaccagggttccctggccccagtagtcaaagtcgactaggagacgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataataggagacgcaggattctgagcgggctggcaaggc

SEQ ID NO: 2191 - DNA, 495 bp, Artificial Sequence
  Oligonucleotide
gcctccctcgcgccatcagtaggagacgtccattccagaaatgcagcaaaacccttcagagttaaagcaggagagaggttgtgaggactcacctgaggagacggtgaccagggttccctggccccagtagtcaaagtcgactaggagacgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacacctaggagacgtccattcctgagcgggctggcaaggc

SEQ ID NO: 2192 - DNA, 495 bp, Artificial Sequence
  Oligonucleotide
gcctccctcgcgccatcagtaggagacgcataactcagaaatgcagcaaaacccttcagagttaaagcaggagagaggttgtgaggactcacctgaggagacggtgaccagggttccctggccccagtagtcaaagtcgactaggagacgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggactaggagacgcataactctgagcgggctggcaaggc

SEQ ID NO: 2193 - DNA, 495 bp, Artificial Sequence
  Oligonucleotide
gcctccctcgcgccatcagtaggagacatatgctgcagaaatgcagcaaaacccttcagagttaaagcaggagagaggttgtgaggactcacctgaggagacggtgaccagggttccctggccccagtagtcaaagtcgactaggagacatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacacctaggagacatatgctgctgagcgggctggcaaggc

SEQ ID NO: 2194 - DNA, 495 bp, Artificial Sequence
  Oligonucleotide
gcctccctcgcgccatcagtaggagacaatcctgccagaaatgcagcaaaacccttcagagttaaagcaggagagaggttgtgaggactcacctgaggagacggtgaccagggttccctggccccagtagtcaaagtcgactaggagacaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgctaggagacaatcctgcctgagcgggctggcaaggc

SEQ ID NO: 2195 - DNA, 495 bp, Artificial Sequence
  Oligonucleotide
gcctccctcgcgccatcagtaggagactgagacctcagaaatgcagcaaaacccttcagagttaaagcaggagagaggttgtgaggactcacctgaggagacggtgaccagggttccctggccccagtagtcaaagtcgactaggagactgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgtaggagactgagacctctgagcgggctggcaaggc

SEQ ID NO: 2196 - DNA, 495 bp, Artificial Sequence
  Oligonucleotide
gcctccctcgcgccatcagtaggagacgaatggaccagaaatgcagcaaaacccttcagagttaaagcaggagagaggttgtgaggactcacctgaggagacggtgaccagggttccctggccccagtagtcaaagtcgactaggagacgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacacctaggagacgaatggacctgagcgggctggcaaggc

SEQ ID NO: 2197 - DNA, 495 bp, Artificial Sequence
  Oligonucleotide
gcctccctcgcgccatcagtaggagaccacatggacagaaatgcagcaaaacccttcagagttaaagcaggagagaggttgtgaggactcacctgaggagacggtgaccagggttccctggccccagtagtcaaagtcgactaggagaccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacacctaggagaccacatggactgagcgggctggcaaggc

SEQ ID NO: 2198 - DNA, 495 bp, Artificial Sequence
  Oligonucleotide
gcctccctcgcgccatcagtaggagacttgaccatcagaaatgcagcaaaacccttcagagttaaagcaggagagaggttgtgaggactcacctgaggagacggtgaccagggttccctggccccagtagtcaaagtcgactaggagacttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacacctaggagacttgaccatctgagcgggctggcaaggc

SEQ ID NO: 2199 - DNA, 495 bp, Artificial Sequence
  Oligonucleotide
gcctccctcgcgccatcagtaggagacaagccatccagaaatgcagcaaaacccttcagagttaaagcaggagagaggttgtgaggactcacctgaggagacggtgaccagggttccctggccccagtagtcaaagtcgactaggagacaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacacctaggagacaagccatcctgagcgggctggcaaggc

SEQ ID NO: 2200 - DNA, 495 bp, Artificial Sequence
  Oligonucleotide
gcctccctcgcgccatcagtaggagactccatgtgcagaaatgcagcaaaacccttcagagttaaagcaggagagaggttgtgaggactcacctgaggagacggtgaccagggttccctggccccagtagtcaaagtcgactaggagactccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacctaggagactccatgtgctgagcgggctggcaaggc

SEQ ID NO: 2201 - DNA, 495 bp, Artificial Sequence
  Oligonucleotide
gcctccctcgcgccatcagtaggagaccaagtcaccagaaatgcagcaaaacccttcagagttaaagcaggagagaggttgtgaggactcacctgaggagacggtgaccagggttccctggccccagtagtcaaagtcgactaggagaccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacctaggagaccaagtcacctgagcgggctggcaaggc

SEQ ID NO: 2202 - DNA, 495 bp, Artificial Sequence
  Oligonucleotide
gcctccctcgcgccatcagtaggagacctgcaatccagaaatgcagcaaaacccttcagagttaaagcaggagagaggttgtgaggactcacctgaggagacggtgaccagggttccctggccccagtagtcaaagtcgactaggagacctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacacctaggagacctgcaatcctgagcgggctggcaaggc

SEQ ID NO: 2203 - DNA, 495 bp, Artificial Sequence
  Oligonucleotide
gcctccctcgcgccatcagtaggagacatcgacgacagaaatgcagcaaaacccttcagagttaaagcaggagagaggttgtgaggactcacctgaggagacggtgaccagggttccctggccccagtagtcaaagtcgactaggagacatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacacctaggagacatcgacgactgagcgggctggcaaggc

SEQ ID NO: 2204 - DNA, 495 bp, Artificial Sequence
  Oligonucleotide
gcctccctcgcgccatcagtaggagacacagactgcagaaatgcagcaaaacccttcagagttaaagcaggagagaggttgtgaggactcacctgaggagacggtgaccagggttccctggccccagtagtcaaagtcgactaggagacacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaataggagacacagactgctgagcgggctggcaaggc

SEQ ID NO: 2205 - DNA, 495 bp, Artificial Sequence
  Oligonucleotide
gcctccctcgcgccatcagtaggagacccttatagcagaaatgcagcaaaacccttcagagttaaagcaggagagaggttgtgaggactcacctgaggagacggtgaccagggttccctggccccagtagtcaaagtcgactaggagacccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggactaggagacccttatagctgagcgggctggcaaggc

SEQ ID NO: 2206 - DNA, 495 bp, Artificial Sequence
  Oligonucleotide
gcctccctcgcgccatcagtaggagactacgcgttcagaaatgcagcaaaacccttcagagttaaagcaggagagaggttgtgaggactcacctgaggagacggtgaccagggttccctggccccagtagtcaaagtcgactaggagactacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacacctaggagactacgcgttctgagcgggctggcaaggc

SEQ ID NO: 2207 - DNA, 495 bp, Artificial Sequence
  Oligonucleotide
gcctccctcgcgccatcagtaggagacctataaggcagaaatgcagcaaaacccttcagagttaaagcaggagagaggttgtgaggactcacctgaggagacggtgaccagggttccctggccccagtagtcaaagtcgactaggagacctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgtaggagacctataaggctgagcgggctggcaaggc

SEQ ID NO: 2208 - DNA, 495 bp, Artificial Sequence
  Oligonucleotide
gcctccctcgcgccatcagtaggagactcttagtccagaaatgcagcaaaacccttcagagttaaagcaggagagaggttgtgaggactcacctgaggagacggtgaccagggttccctggccccagtagtcaaagtcgactaggagactcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgctaggagactcttagtcctgagcgggctggcaaggc

SEQ ID NO: 2209 - DNA, 495 bp, Artificial Sequence
  Oligonucleotide
gcctccctcgcgccatcagtaggagactgtctgcacagaaatgcagcaaaacccttcagagttaaagcaggagagaggttgtgaggactcacctgaggagacggtgaccagggttccctggccccagtagtcaaagtcgactaggagactgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacacctaggagactgtctgcactgagcgggctggcaaggc

SEQ ID NO: 2210 - DNA, 495 bp, Artificial Sequence
  Oligonucleotide
gcctccctcgcgccatcagtaggagacgccattaacagaaatgcagcaaaacccttcagagttaaagcaggagagaggttgtgaggactcacctgaggagacggtgaccagggttccctggccccagtagtcaaagtcgactaggagacgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgctaggagacgccattaactgagcgggctggcaaggc

SEQ ID NO: 2211 - DNA, 495 bp, Artificial Sequence
  Oligonucleotide
gcctccctcgcgccatcagtaggagacgactaagacagaaatgcagcaaaacccttcagagttaaagcaggagagaggttgtgaggactcacctgaggagacggtgaccagggttccctggccccagtagtcaaagtcgactaggagacgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgtaggagacgactaagactgagcgggctggcaaggc

SEQ ID NO: 2212 - DNA, 495 bp, Artificial Sequence
  Oligonucleotide
gcctccctcgcgccatcagtaggagacaggttgctcagaaatgcagcaaaacccttcagagttaaagcaggagagaggttgtgaggactcacctgaggagacggtgaccagggttccctggccccagtagtcaaagtcgactaggagacaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgtaggagacaggttgctctgagcgggctggcaaggc

SEQ ID NO: 2213 - DNA, 495 bp, Artificial Sequence
  Oligonucleotide
gcctccctcgcgccatcagtaggagacctcgagaacagaaatgcagcaaaacccttcagagttaaagcaggagagaggttgtgaggactcacctgaggagacggtgaccagggttccctggccccagtagtcaaagtcgactaggagacctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacacctaggagacctcgagaactgagcgggctggcaaggc

SEQ ID NO: 2214 - DNA, 495 bp, Artificial Sequence
  Oligonucleotide
gcctccctcgcgccatcagtaggagacttaatggccagaaatgcagcaaaacccttcagagttaaagcaggagagaggttgtgaggactcacctgaggagacggtgaccagggttccctggccccagtagtcaaagtcgactaggagacttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacacctaggagacttaatggcctgagcgggctggcaaggc

SEQ ID NO: 2215 - DNA, 495 bp, Artificial Sequence
  Oligonucleotide
gcctccctcgcgccatcagtaggagactgcagacacagaaatgcagcaaaacccttcagagttaaagcaggagagaggttgtgaggactcacctgaggagacggtgaccagggttccctggccccagtagtcaaagtcgactaggagactgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaataggagactgcagacactgagcgggctggcaaggc

SEQ ID NO: 2216 - DNA, 495 bp, Artificial Sequence
  Oligonucleotide
gcctccctcgcgccatcagtaggagactcactgagcagaaatgcagcaaaacccttcagagttaaagcaggagagaggttgtgaggactcacctgaggagacggtgaccagggttccctggccccagtagtcaaagtcgactaggagactcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgttaggagactcactgagctgagcgggctggcaaggc

SEQ ID NO: 2217 - DNA, 495 bp, Artificial Sequence
  Oligonucleotide
gcctccctcgcgccatcagtaggagacgagtacgtcagaaatgcagcaaaacccttcagagttaaagcaggagagaggttgtgaggactcacctgaggagacggtgaccagggttccctggccccagtagtcaaagtcgactaggagacgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccactaggagacgagtacgtctgagcgggctggcaaggc

SEQ ID NO: 2218 - DNA, 495 bp, Artificial Sequence
  Oligonucleotide
gcctccctcgcgccatcagtaggagacatacgccacagaaatgcagcaaaacccttcagagttaaagcaggagagaggttgtgaggactcacctgaggagacggtgaccagggttccctggccccagtagtcaaagtcgactaggagacatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggactaggagacatacgccactgagcgggctggcaaggc

SEQ ID NO: 2219 - DNA, 495 bp, Artificial Sequence
  Oligonucleotide
gcctccctcgcgccatcagtaggagactcgcatcacagaaatgcagcaaaacccttcagagttaaagcaggagagaggttgtgaggactcacctgaggagacggtgaccagggttccctggccccagtagtcaaagtcgactaggagactcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggactaggagactcgcatcactgagcgggctggcaaggc

SEQ ID NO: 2220 - DNA, 495 bp, Artificial Sequence
  Oligonucleotide
gcctccctcgcgccatcagtaggagaccgcttaatcagaaatgcagcaaaacccttcagagttaaagcaggagagaggttgtgaggactcacctgaggagacggtgaccagggttccctggccccagtagtcaaagtcgactaggagaccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggactaggagaccgcttaatctgagcgggctggcaaggc

SEQ ID NO: 2221 - DNA, 495 bp, Artificial Sequence
  Oligonucleotide
gcctccctcgcgccatcagtaggagactggttatccagaaatgcagcaaaacccttcagagttaaagcaggagagaggttgtgaggactcacctgaggagacggtgaccagggttccctggccccagtagtcaaagtcgactaggagactggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgttaggagactggttatcctgagcgggctggcaaggc

SEQ ID NO: 2222 - DNA, 495 bp, Artificial Sequence
  Oligonucleotide
gcctccctcgcgccatcagtaggagacggattgctcagaaatgcagcaaaacccttcagagttaaagcaggagagaggttgtgaggactcacctgaggagacggtgaccagggttccctggccccagtagtcaaagtcgactaggagacggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggactaggagacggattgctctgagcgggctggcaaggc

SEQ ID NO: 2223 - DNA, 495 bp, Artificial Sequence
  Oligonucleotide
gcctccctcgcgccatcagtaggagacctcagtgacagaaatgcagcaaaacccttcagagttaaagcaggagagaggttgtgaggactcacctgaggagacggtgaccagggttccctggccccagtagtcaaagtcgactaggagacctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgttaggagacctcagtgactgagcgggctggcaaggc

SEQ ID NO: 2224 - DNA, 495 bp, Artificial Sequence
  Oligonucleotide
gcctccctcgcgccatcagtaggagacacgtactccagaaatgcagcaaaacccttcagagttaaagcaggagagaggttgtgaggactcacctgaggagacggtgaccagggttccctggccccagtagtcaaagtcgactaggagacacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggactaggagacacgtactcctgagcgggctggcaaggc

SEQ ID NO: 2225 - DNA, 495 bp, Artificial Sequence
  Oligonucleotide
gcctccctcgcgccatcagtaggagactgatgcgacagaaatgcagcaaaacccttcagagttaaagcaggagagaggttgtgaggactcacctgaggagacggtgaccagggttccctggccccagtagtcaaagtcgactaggagactgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggacccctaggagactgatgcgactgagcgggctggcaaggc

SEQ ID NO: 2226 - DNA, 495 bp, Artificial Sequence
  Oligonucleotide
gcctccctcgcgccatcagtaggagacattaagcgcagaaatgcagcaaaacccttcagagttaaagcaggagagaggttgtgaggactcacctgaggagacggtgaccagggttccctggccccagtagtcaaagtcgactaggagacattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactcctaggagacattaagcgctgagcgggctggcaaggc

SEQ ID NO: 2227 - DNA, 495 bp, Artificial Sequence
  Oligonucleotide
gcctccctcgcgccatcagtaggagacagcaatcccagaaatgcagcaaaacccttcagagttaaagcaggagagaggttgtgaggactcacctgaggagacggtgaccagggttccctggccccagtagtcaaagtcgactaggagacagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactcctaggagacagcaatccctgagcgggctggcaaggc

SEQ ID NO: 2228 - DNA, 495 bp, Artificial Sequence
  Oligonucleotide
gcctccctcgcgccatcagtaggagacgcttagtacagaaatgcagcaaaacccttcagagttaaagcaggagagaggttgtgaggactcacctgaggagacggtgaccagggttccctggccccagtagtcaaagtcgactaggagacgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgataggagacgcttagtactgagcgggctggcaaggc

SEQ ID NO: 2229 - DNA, 495 bp, Artificial Sequence
  Oligonucleotide
gcctccctcgcgccatcagtaggagactgaccttgcagaaatgcagcaaaacccttcagagttaaagcaggagagaggttgtgaggactcacctgaggagacggtgaccagggttccctggccccagtagtcaaagtcgactaggagactgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcacctaggagactgaccttgctgagcgggctggcaaggc

SEQ ID NO: 2230 - DNA, 495 bp, Artificial Sequence
  Oligonucleotide
gcctccctcgcgccatcagtaggagaccaaggtcacagaaatgcagcaaaacccttcagagttaaagcaggagagaggttgtgaggactcacctgaggagacggtgaccagggttccctggccccagtagtcaaagtcgactaggagaccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtacctaggagaccaaggtcactgagcgggctggcaaggc

SEQ ID NO: 2231 - DNA, 495 bp, Artificial Sequence
  Oligonucleotide
gcctccctcgcgccatcagtaggagaccactgtaccagaaatgcagcaaaacccttcagagttaaagcaggagagaggttgtgaggactcacctgaggagacggtgaccagggttccctggccccagtagtcaaagtcgactaggagaccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttctaggagaccactgtacctgagcgggctggcaaggc

SEQ ID NO: 2232 - DNA, 495 bp, Artificial Sequence
  Oligonucleotide
gcctccctcgcgccatcagtaggagacgatgatcccagaaatgcagcaaaacccttcagagttaaagcaggagagaggttgtgaggactcacctgaggagacggtgaccagggttccctggccccagtagtcaaagtcgactaggagacgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggtaggagacgatgatccctgagcgggctggcaaggc

SEQ ID NO: 2233 - DNA, 495 bp, Artificial Sequence
  Oligonucleotide
gcctccctcgcgccatcagtaggagaccgccaatacagaaatgcagcaaaacccttcagagttaaagcaggagagaggttgtgaggactcacctgaggagacggtgaccagggttccctggccccagtagtcaaagtcgactaggagaccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggtaggagaccgccaatactgagcgggctggcaaggc

SEQ ID NO: 2234 - DNA, 495 bp, Artificial Sequence
  Oligonucleotide
gcctccctcgcgccatcagtaggagactcaagcctcagaaatgcagcaaaacccttcagagttaaagcaggagagaggttgtgaggactcacctgaggagacggtgaccagggttccctggccccagtagtcaaagtcgactaggagactcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacataggagactcaagcctctgagcgggctggcaaggc

SEQ ID NO: 2235 - DNA, 495 bp, Artificial Sequence
  Oligonucleotide
gcctccctcgcgccatcagtaggagacacgtgtgtcagaaatgcagcaaaacccttcagagttaaagcaggagagaggttgtgaggactcacctgaggagacggtgaccagggttccctggccccagtagtcaaagtcgactaggagacacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagtaggagacacgtgtgtctgagcgggctggcaaggc

SEQ ID NO: 2236 - DNA, 495 bp, Artificial Sequence
  Oligonucleotide
gcctccctcgcgccatcagtaggagactccgtctacagaaatgcagcaaaacccttcagagttaaagcaggagagaggttgtgaggactcacctgaggagacggtgaccagggttccctggccccagtagtcaaagtcgactaggagactccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagtaggagactccgtctactgagcgggctggcaaggc

SEQ ID NO: 2237 - DNA, 495 bp, Artificial Sequence
  Oligonucleotide
gcctccctcgcgccatcagtaggagacaagagctgcagaaatgcagcaaaacccttcagagttaaagcaggagagaggttgtgaggactcacctgaggagacggtgaccagggttccctggccccagtagtcaaagtcgactaggagacaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgtaggagacaagagctgctgagcgggctggcaaggc

SEQ ID NO: 2238 - DNA, 495 bp, Artificial Sequence
  Oligonucleotide
gcctccctcgcgccatcagtaggagactatcgctccagaaatgcagcaaaacccttcagagttaaagcaggagagaggttgtgaggactcacctgaggagacggtgaccagggttccctggccccagtagtcaaagtcgactaggagactatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagtaggagactatcgctcctgagcgggctggcaaggc

SEQ ID NO: 2239 - DNA, 495 bp, Artificial Sequence
  Oligonucleotide
gcctccctcgcgccatcagtaggagactcagatgccagaaatgcagcaaaacccttcagagttaaagcaggagagaggttgtgaggactcacctgaggagacggtgaccagggttccctggccccagtagtcaaagtcgactaggagactcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaaccctaggagactcagatgcctgagcgggctggcaaggc

SEQ ID NO: 2240 - DNA, 495 bp, Artificial Sequence
  Oligonucleotide
gcctccctcgcgccatcagtaggagacgtgtagcacagaaatgcagcaaaacccttcagagttaaagcaggagagaggttgtgaggactcacctgaggagacggtgaccagggttccctggccccagtagtcaaagtcgactaggagacgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgtaggagacgtgtagcactgagcgggctggcaaggc

SEQ ID NO: 2241 - DNA, 495 bp, Artificial Sequence
  Oligonucleotide
gcctccctcgcgccatcagtaggagactggcagttcagaaatgcagcaaaacccttcagagttaaagcaggagagaggttgtgaggactcacctgaggagacggtgaccagggttccctggccccagtagtcaaagtcgactaggagactggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgtaggagactggcagttctgagcgggctggcaaggc

SEQ ID NO: 2242 - DNA, 495 bp, Artificial Sequence
  Oligonucleotide
gcctccctcgcgccatcagtaggagaccagtccaacagaaatgcagcaaaacccttcagagttaaagcaggagagaggttgtgaggactcacctgaggagacggtgaccagggttccctggccccagtagtcaaagtcgactaggagaccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcactaggagaccagtccaactgagcgggctggcaaggc

SEQ ID NO: 2243 - DNA, 495 bp, Artificial Sequence
  Oligonucleotide
gcctccctcgcgccatcagtaggagacgtgtctaccagaaatgcagcaaaacccttcagagttaaagcaggagagaggttgtgaggactcacctgaggagacggtgaccagggttccctggccccagtagtcaaagtcgactaggagacgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggtaggagacgtgtctacctgagcgggctggcaaggc

SEQ ID NO: 2244 - DNA, 495 bp, Artificial Sequence
  Oligonucleotide
gcctccctcgcgccatcagtaggagacgtacagtgcagaaatgcagcaaaacccttcagagttaaagcaggagagaggttgtgaggactcacctgaggagacggtgaccagggttccctggccccagtagtcaaagtcgactaggagacgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagtaggagacgtacagtgctgagcgggctggcaaggc

SEQ ID NO: 2245 - DNA, 495 bp, Artificial Sequence
  Oligonucleotide
gcctccctcgcgccatcagtaggagacggatcatccagaaatgcagcaaaacccttcagagttaaagcaggagagaggttgtgaggactcacctgaggagacggtgaccagggttccctggccccagtagtcaaagtcgactaggagacggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagtaggagacggatcatcctgagcgggctggcaaggc

SEQ ID NO: 2246 - DNA, 495 bp, Artificial Sequence
  Oligonucleotide
gcctccctcgcgccatcagtaggagactattggcgcagaaatgcagcaaaacccttcagagttaaagcaggagagaggttgtgaggactcacctgaggagacggtgaccagggttccctggccccagtagtcaaagtcgactaggagactattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcataggagactattggcgctgagcgggctggcaaggc

SEQ ID NO: 2247 - DNA, 495 bp, Artificial Sequence
  Oligonucleotide
gcctccctcgcgccatcagtaggagacaggcttgacagaaatgcagcaaaacccttcagagttaaagcaggagagaggttgtgaggactcacctgaggagacggtgaccagggttccctggccccagtagtcaaagtcgactaggagacaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcactaggagacaggcttgactgagcgggctggcaaggc

SEQ ID NO: 2248 - DNA, 495 bp, Artificial Sequence
  Oligonucleotide
gcctccctcgcgccatcagtaggagacacacacgtcagaaatgcagcaaaacccttcagagttaaagcaggagagaggttgtgaggactcacctgaggagacggtgaccagggttccctggccccagtagtcaaagtcgactaggagacacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcattaggagacacacacgtctgagcgggctggcaaggc

SEQ ID NO: 2249 - DNA, 495 bp, Artificial Sequence
  Oligonucleotide
gcctccctcgcgccatcagtaggagactagacggacagaaatgcagcaaaacccttcagagttaaagcaggagagaggttgtgaggactcacctgaggagacggtgaccagggttccctggccccagtagtcaaagtcgactaggagactagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgataggagactagacggactgagcgggctggcaaggc

SEQ ID NO: 2250 - DNA, 495 bp, Artificial Sequence
  Oligonucleotide
gcctccctcgcgccatcagtaggagacgagcgatacagaaatgcagcaaaacccttcagagttaaagcaggagagaggttgtgaggactcacctgaggagacggtgaccagggttccctggccccagtagtcaaagtcgactaggagacgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggtttttaggagacgagcgatactgagcgggctggcaaggc

SEQ ID NO: 2251 - DNA, 495 bp, Artificial Sequence
  Oligonucleotide
gcctccctcgcgccatcagtaggagacgcatctgacagaaatgcagcaaaacccttcagagttaaagcaggagagaggttgtgaggactcacctgaggagacggtgaccagggttccctggccccagtagtcaaagtcgactaggagacgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacataggagacgcatctgactgagcgggctggcaaggc

SEQ ID NO: 2252 - DNA, 495 bp, Artificial Sequence
  Oligonucleotide
gcctccctcgcgccatcagtaggagactgctacaccagaaatgcagcaaaacccttcagagttaaagcaggagagaggttgtgaggactcacctgaggagacggtgaccagggttccctggccccagtagtcaaagtcgactaggagactgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgtaggagactgctacacctgagcgggctggcaaggc

SEQ ID NO: 2253 - DNA, 495 bp, Artificial Sequence
  Oligonucleotide
gcctccctcgcgccatcagtaggagacaactgccacagaaatgcagcaaaacccttcagagttaaagcaggagagaggttgtgaggactcacctgaggagacggtgaccagggttccctggccccagtagtcaaagtcgactaggagacaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggactttaggagacaactgccactgagcgggctggcaaggc

SEQ ID NO: 2254 - DNA, 495 bp, Artificial Sequence
  Oligonucleotide
gcctccctcgcgccatcagtaggagacttggactgcagaaatgcagcaaaacccttcagagttaaagcaggagagaggttgtgaggactcacctgaggagacggtgaccagggttccctggccccagtagtcaaagtcgactaggagacttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggtaggagacttggactgctgagcgggctggcaaggc

SEQ ID NO: 2255 - DNA, 495 bp, Artificial Sequence
  Oligonucleotide
gcctccctcgcgccatcagtaggagactcggtactcagaaatgcagcaaaacccttcagagttaaagcaggagagaggttgtgaggactcacctgaggagacggtgaccagggttccctggccccagtagtcaaagtcgactaggagactcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgtaggagactcggtactctgagcgggctggcaaggc

SEQ ID NO: 2256 - DNA, 495 bp, Artificial Sequence
  Oligonucleotide
gcctccctcgcgccatcagtaggagacccatggatcagaaatgcagcaaaacccttcagagttaaagcaggagagaggttgtgaggactcacctgaggagacggtgaccagggttccctggccccagtagtcaaagtcgactaggagacccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatactaggagacccatggatctgagcgggctggcaaggc

SEQ ID NO: 2257 - DNA, 495 bp, Artificial Sequence
  Oligonucleotide
gcctccctcgcgccatcagtaggagacacgaagatcagaaatgcagcaaaacccttcagagttaaagcaggagagaggttgtgaggactcacctgaggagacggtgaccagggttccctggccccagtagtcaaagtcgactaggagacacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaataggagacacgaagatctgagcgggctggcaaggc

SEQ ID NO: 2258 - DNA, 495 bp, Artificial Sequence
  Oligonucleotide
gcctccctcgcgccatcagtaggagacactgtggacagaaatgcagcaaaacccttcagagttaaagcaggagagaggttgtgaggactcacctgaggagacggtgaccagggttccctggccccagtagtcaaagtcgactaggagacactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggactttaggagacactgtggactgagcgggctggcaaggc

SEQ ID NO: 2259 - DNA, 495 bp, Artificial Sequence
  Oligonucleotide
gcctccctcgcgccatcagtaggagacggtgtcatcagaaatgcagcaaaacccttcagagttaaagcaggagagaggttgtgaggactcacctgaggagacggtgaccagggttccctggccccagtagtcaaagtcgactaggagacggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactcttaggagacggtgtcatctgagcgggctggcaaggc

SEQ ID NO: 2260 - DNA, 495 bp, Artificial Sequence
  Oligonucleotide
gcctccctcgcgccatcagtaggagactcgtgaagcagaaatgcagcaaaacccttcagagttaaagcaggagagaggttgtgaggactcacctgaggagacggtgaccagggttccctggccccagtagtcaaagtcgactaggagactcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggtaggagactcgtgaagctgagcgggctggcaaggc

SEQ ID NO: 2261 - DNA, 495 bp, Artificial Sequence
  Oligonucleotide
gcctccctcgcgccatcagtaggagaccactagctcagaaatgcagcaaaacccttcagagttaaagcaggagagaggttgtgaggactcacctgaggagacggtgaccagggttccctggccccagtagtcaaagtcgactaggagaccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaataggagaccactagctctgagcgggctggcaaggc

SEQ ID NO: 2262 - DNA, 495 bp, Artificial Sequence
  Oligonucleotide
gcctccctcgcgccatcagtaggagacggtcaactcagaaatgcagcaaaacccttcagagttaaagcaggagagaggttgtgaggactcacctgaggagacggtgaccagggttccctggccccagtagtcaaagtcgactaggagacggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggataggagacggtcaactctgagcgggctggcaaggc

SEQ ID NO: 2263 - DNA, 495 bp, Artificial Sequence
  Oligonucleotide
gcctccctcgcgccatcagtaggagactacgtacgcagaaatgcagcaaaacccttcagagttaaagcaggagagaggttgtgaggactcacctgaggagacggtgaccagggttccctggccccagtagtcaaagtcgactaggagactacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatctaggagactacgtacgctgagcgggctggcaaggc

SEQ ID NO: 2264 - DNA, 495 bp, Artificial Sequence
  Oligonucleotide
gcctccctcgcgccatcagtaggagacatgacacccagaaatgcagcaaaacccttcagagttaaagcaggagagaggttgtgaggactcacctgaggagacggtgaccagggttccctggccccagtagtcaaagtcgactaggagacatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggtaggagacatgacaccctgagcgggctggcaaggc

SEQ ID NO: 2265 - DNA, 495 bp, Artificial Sequence
  Oligonucleotide
gcctccctcgcgccatcagtaggagaccttcacgacagaaatgcagcaaaacccttcagagttaaagcaggagagaggttgtgaggactcacctgaggagacggtgaccagggttccctggccccagtagtcaaagtcgactaggagaccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacactaggagaccttcacgactgagcgggctggcaaggc

SEQ ID NO: 2266 - DNA, 495 bp, Artificial Sequence
  Oligonucleotide
gcctccctcgcgccatcagtaggagacagaatcagcagaaatgcagcaaaacccttcagagttaaagcaggagagaggttgtgaggactcacctgaggagacggtgaccagggttccctggccccagtagtcaaagtcgactaggagacagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacacctaggagacagaatcagctgagcgggctggcaaggc

SEQ ID NO: 2267 - DNA, 495 bp, Artificial Sequence
  Oligonucleotide
gcctccctcgcgccatcagtaggagacagttatgccagaaatgcagcaaaacccttcagagttaaagcaggagagaggttgtgaggactcacctgaggagacggtgaccagggttccctggccccagtagtcaaagtcgactaggagacagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataataggagacagttatgcctgagcgggctggcaaggc

SEQ ID NO: 2268 - DNA, 495 bp, Artificial Sequence
  Oligonucleotide
gcctccctcgcgccatcagtaggagacaggtctcacagaaatgcagcaaaacccttcagagttaaagcaggagagaggttgtgaggactcacctgaggagacggtgaccagggttccctggccccagtagtcaaagtcgactaggagacaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacacctaggagacaggtctcactgagcgggctggcaaggc

SEQ ID NO: 2269 - DNA, 495 bp, Artificial Sequence
  Oligonucleotide
gcctccctcgcgccatcagtaggagacgtcatagtcagaaatgcagcaaaacccttcagagttaaagcaggagagaggttgtgaggactcacctgaggagacggtgaccagggttccctggccccagtagtcaaagtcgactaggagacgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggttaggagacgtcatagtctgagcgggctggcaaggc

SEQ ID NO: 2270 - DNA, 495 bp, Artificial Sequence
  Oligonucleotide
gcctccctcgcgccatcagtaggagacgtgacttgcagaaatgcagcaaaacccttcagagttaaagcaggagagaggttgtgaggactcacctgaggagacggtgaccagggttccctggccccagtagtcaaagtcgactaggagacgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgtaggagacgtgacttgctgagcgggctggcaaggc

SEQ ID NO: 2271 - DNA, 495 bp, Artificial Sequence
  Oligonucleotide
gcctccctcgcgccatcagtaggagacgattgcagcagaaatgcagcaaaacccttcagagttaaagcaggagagaggttgtgaggactcacctgaggagacggtgaccagggttccctggccccagtagtcaaagtcgactaggagacgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggatacctaggagacgattgcagctgagcgggctggcaaggc

SEQ ID NO: 2272 - DNA, 495 bp, Artificial Sequence
  Oligonucleotide
gcctccctcgcgccatcagtaggagacactatgaccagaaatgcagcaaaacccttcagagttaaagcaggagagaggttgtgaggactcacctgaggagacggtgaccagggttccctggccccagtagtcaaagtcgactaggagacactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaactaggagacactatgacctgagcgggctggcaaggc

SEQ ID NO: 2273 - DNA, 495 bp, Artificial Sequence
  Oligonucleotide
gcctccctcgcgccatcagtaggagacatggtcaacagaaatgcagcaaaacccttcagagttaaagcaggagagaggttgtgaggactcacctgaggagacggtgaccagggttccctggccccagtagtcaaagtcgactaggagacatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagactaggagacatggtcaactgagcgggctggcaaggc

SEQ ID NO: 2274 - DNA, 495 bp, Artificial Sequence
  Oligonucleotide
gcctccctcgcgccatcagtaggagacgatggcttcagaaatgcagcaaaacccttcagagttaaagcaggagagaggttgtgaggactcacctgaggagacggtgaccagggttccctggccccagtagtcaaagtcgactaggagacgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaactaggagacgatggcttctgagcgggctggcaaggc

SEQ ID NO: 2275 - DNA, 495 bp, Artificial Sequence
  Oligonucleotide
gcctccctcgcgccatcagtaggagacagcatatgcagaaatgcagcaaaacccttcagagttaaagcaggagagaggttgtgaggactcacctgaggagacggtgaccagggttccctggccccagtagtcaaagtcgactaggagacagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagactaggagacagcatatgctgagcgggctggcaaggc

SEQ ID NO: 2276 - DNA, 495 bp, Artificial Sequence
  Oligonucleotide
gcctccctcgcgccatcagtaggagaccatatgctcagaaatgcagcaaaacccttcagagttaaagcaggagagaggttgtgaggactcacctgaggagacggtgaccagggttccctggccccagtagtcaaagtcgactaggagaccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgtaggagaccatatgctctgagcgggctggcaaggc

SEQ ID NO: 2277 - DNA, 495 bp, Artificial Sequence
  Oligonucleotide
gcctccctcgcgccatcagtaggagactcgtcgatcagaaatgcagcaaaacccttcagagttaaagcaggagagaggttgtgaggactcacctgaggagacggtgaccagggttccctggccccagtagtcaaagtcgactaggagactcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacacctaggagactcgtcgatctgagcgggctggcaaggc

SEQ ID NO: 2278 - DNA, 495 bp, Artificial Sequence
  Oligonucleotide
gcctccctcgcgccatcagtaggagaccagtctgtcagaaatgcagcaaaacccttcagagttaaagcaggagagaggttgtgaggactcacctgaggagacggtgaccagggttccctggccccagtagtcaaagtcgactaggagaccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgctaggagaccagtctgtctgagcgggctggcaaggc

SEQ ID NO: 2279 - DNA, 495 bp, Artificial Sequence
  Oligonucleotide
gcctccctcgcgccatcagtaggagacaacgcgtacagaaatgcagcaaaacccttcagagttaaagcaggagagaggttgtgaggactcacctgaggagacggtgaccagggttccctggccccagtagtcaaagtcgactaggagacaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgtaggagacaacgcgtactgagcgggctggcaaggc

SEQ ID NO: 2280 - DNA, 495 bp, Artificial Sequence
  Oligonucleotide
gcctccctcgcgccatcagtaggagacgtagttcgcagaaatgcagcaaaacccttcagagttaaagcaggagagaggttgtgaggactcacctgaggagacggtgaccagggttccctggccccagtagtcaaagtcgactaggagacgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgctaggagacgtagttcgctgagcgggctggcaaggc

SEQ ID NO: 2281 - DNA, 495 bp, Artificial Sequence
  Oligonucleotide
gcctccctcgcgccatcagtaggagaccgaactaccagaaatgcagcaaaacccttcagagttaaagcaggagagaggttgtgaggactcacctgaggagacggtgaccagggttccctggccccagtagtcaaagtcgactaggagaccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagactaggagaccgaactacctgagcgggctggcaaggc

SEQ ID NO: 2282 - DNA, 495 bp, Artificial Sequence
  Oligonucleotide
gcctccctcgcgccatcagtaggagacttaacgtccagaaatgcagcaaaacccttcagagttaaagcaggagagaggttgtgaggactcacctgaggagacggtgaccagggttccctggccccagtagtcaaagtcgactaggagacttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacacctaggagacttaacgtcctgagcgggctggcaaggc

SEQ ID NO: 2283 - DNA, 495 bp, Artificial Sequence
  Oligonucleotide
gcctccctcgcgccatcagtaggagacagcaacctcagaaatgcagcaaaacccttcagagttaaagcaggagagaggttgtgaggactcacctgaggagacggtgaccagggttccctggccccagtagtcaaagtcgactaggagacagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggactaggagacagcaacctctgagcgggctggcaaggc

SEQ ID NO: 2284 - DNA, 495 bp, Artificial Sequence
  Oligonucleotide
gcctccctcgcgccatcagtaggagacttctcgagcagaaatgcagcaaaacccttcagagttaaagcaggagagaggttgtgaggactcacctgaggagacggtgaccagggttccctggccccagtagtcaaagtcgactaggagacttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggactttaggagacttctcgagctgagcgggctggcaaggc

SEQ ID NO: 2285 - DNA, 495 bp, Artificial Sequence
  Oligonucleotide
gcctccctcgcgccatcagtaggagacactctacgcagaaatgcagcaaaacccttcagagttaaagcaggagagaggttgtgaggactcacctgaggagacggtgaccagggttccctggccccagtagtcaaagtcgactaggagacactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggactaggagacactctacgctgagcgggctggcaaggc

SEQ ID NO: 2286 - DNA, 495 bp, Artificial Sequence
  Oligonucleotide
gcctccctcgcgccatcagtaggagactaccggaacagaaatgcagcaaaacccttcagagttaaagcaggagagaggttgtgaggactcacctgaggagacggtgaccagggttccctggccccagtagtcaaagtcgactaggagactaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacacctaggagactaccggaactgagcgggctggcaaggc

SEQ ID NO: 2287 - DNA, 495 bp, Artificial Sequence
  Oligonucleotide
gcctccctcgcgccatcagtaggagaccgaattgccagaaatgcagcaaaacccttcagagttaaagcaggagagaggttgtgaggactcacctgaggagacggtgaccagggttccctggccccagtagtcaaagtcgactaggagaccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaactaggagaccgaattgcctgagcgggctggcaaggc

SEQ ID NO: 2288 - DNA, 495 bp, Artificial Sequence
  Oligonucleotide
gcctccctcgcgccatcagtaggagacttcgctcacagaaatgcagcaaaacccttcagagttaaagcaggagagaggttgtgaggactcacctgaggagacggtgaccagggttccctggccccagtagtcaaagtcgactaggagacttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacataggagacttcgctcactgagcgggctggcaaggc

SEQ ID NO: 2289 - DNA, 495 bp, Artificial Sequence
  Oligonucleotide
gcctccctcgcgccatcagtaggagacgacgttaacagaaatgcagcaaaacccttcagagttaaagcaggagagaggttgtgaggactcacctgaggagacggtgaccagggttccctggccccagtagtcaaagtcgactaggagacgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgtaggagacgacgttaactgagcgggctggcaaggc

SEQ ID NO: 2290 - DNA, 495 bp, Artificial Sequence
  Oligonucleotide
gcctccctcgcgccatcagtaggagaccgtagagtcagaaatgcagcaaaacccttcagagttaaagcaggagagaggttgtgaggactcacctgaggagacggtgaccagggttccctggccccagtagtcaaagtcgactaggagaccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgctaggagaccgtagagtctgagcgggctggcaaggc

SEQ ID NO: 2291 - DNA, 495 bp, Artificial Sequence
  Oligonucleotide
gcctccctcgcgccatcagtaggagacttccggtacagaaatgcagcaaaacccttcagagttaaagcaggagagaggttgtgaggactcacctgaggagacggtgaccagggttccctggccccagtagtcaaagtcgactaggagacttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgctaggagacttccggtactgagcgggctggcaaggc

SEQ ID NO: 2292 - DNA, 495 bp, Artificial Sequence
  Oligonucleotide
gcctccctcgcgccatcagtaggagacgcaattcgcagaaatgcagcaaaacccttcagagttaaagcaggagagaggttgtgaggactcacctgaggagacggtgaccagggttccctggccccagtagtcaaagtcgactaggagacgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacactaggagacgcaattcgctgagcgggctggcaaggc

SEQ ID NO: 2293 - DNA, 495 bp, Artificial Sequence
  Oligonucleotide
gcctccctcgcgccatcagtaggagactgagcgaacagaaatgcagcaaaacccttcagagttaaagcaggagagaggttgtgaggactcacctgaggagacggtgaccagggttccctggccccagtagtcaaagtcgactaggagactgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgctaggagactgagcgaactgagcgggctggcaaggc

SEQ ID NO: 2294 - DNA, 495 bp, Artificial Sequence
  Oligonucleotide
gcctccctcgcgccatcagtaggagactactaagccagaaatgcagcaaaacccttcagagttaaagcaggagagaggttgtgaggactcacctgaggagacggtgaccagggttccctggccccagtagtcaaagtcgactaggagactactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggacccctaggagactactaagcctgagcgggctggcaaggc

SEQ ID NO: 2295 - DNA, 495 bp, Artificial Sequence
  Oligonucleotide
gcctccctcgcgccatcagtaggagactggcgtatcagaaatgcagcaaaacccttcagagttaaagcaggagagaggttgtgaggactcacctgaggagacggtgaccagggttccctggccccagtagtcaaagtcgactaggagactggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgttaggagactggcgtatctgagcgggctggcaaggc

SEQ ID NO: 2296 - DNA, 495 bp, Artificial Sequence
  Oligonucleotide
gcctccctcgcgccatcagtaggagacgataaccacagaaatgcagcaaaacccttcagagttaaagcaggagagaggttgtgaggactcacctgaggagacggtgaccagggttccctggccccagtagtcaaagtcgactaggagacgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgtaggagacgataaccactgagcgggctggcaaggc

SEQ ID NO: 2297 - DNA, 495 bp, Artificial Sequence
  Oligonucleotide
gcctccctcgcgccatcagtaggagacctagtgaacagaaatgcagcaaaacccttcagagttaaagcaggagagaggttgtgaggactcacctgaggagacggtgaccagggttccctggccccagtagtcaaagtcgactaggagacctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagtaggagacctagtgaactgagcgggctggcaaggc

SEQ ID NO: 2298 - DNA, 495 bp, Artificial Sequence
  Oligonucleotide
gcctccctcgcgccatcagtaggagacacgttcaccagaaatgcagcaaaacccttcagagttaaagcaggagagaggttgtgaggactcacctgaggagacggtgaccagggttccctggccccagtagtcaaagtcgactaggagacacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgttaggagacacgttcacctgagcgggctggcaaggc

SEQ ID NO: 2299 - DNA, 448 bp, Artificial Sequence
  Oligonucleotide
gcctccctcgcgccatcagtaggagacattacgctcagaaatgcagcaaaacccttcagagttaaagcaggagagaggttgtgaggactcacctgaggagacggtgaccagggttccctggccccagtagtcaaagtcgactaggagacattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcataggagacattacgctctgagcgggctggcaaggc

SEQ ID NO: 2300 - DNA, 495 bp, Artificial Sequence
  Oligonucleotide
gcctccctcgcgccatcagtaggagaccattgagtcagaaatgcagcaaaacccttcagagttaaagcaggagagaggttgtgaggactcacctgaggagacggtgaccagggttccctggccccagtagtcaaagtcgactaggagaccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcacctaggagaccattgagtctgagcgggctggcaaggc

SEQ ID NO: 2301 - DNA, 495 bp, Artificial Sequence
  Oligonucleotide
gcctccctcgcgccatcaggacactctcttggttactggcaagctgagtctccctaagtggactcagagagggggtggtgaggactcacctgaggagacggtgaccagggttccctggccccaggggtcgaaccagtcgacgacactctcttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgacactctcttggttactgagcgggctggcaaggc

SEQ ID NO: 2302 - DNA, 495 bp, Artificial Sequence
  Oligonucleotide
gcctccctcgcgccatcaggacactctacctcttgctggcaagctgagtctccctaagtggactcagagagggggtggtgaggactcacctgaggagacggtgaccagggttccctggccccaggggtcgaaccagtcgacgacactctacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgacactctacctcttgctgagcgggctggcaaggc

SEQ ID NO: 2303 - DNA, 495 bp, Artificial Sequence
  Oligonucleotide
gcctccctcgcgccatcaggacactctctgattctctggcaagctgagtctccctaagtggactcagagagggggtggtgaggactcacctgaggagacggtgaccagggttccctggccccaggggtcgaaccagtcgacgacactctctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgacactctctgattctctgagcgggctggcaaggc

SEQ ID NO: 2304 - DNA, 495 bp, Artificial Sequence
  Oligonucleotide
gcctccctcgcgccatcaggacactctagtaccgactggcaagctgagtctccctaagtggactcagagagggggtggtgaggactcacctgaggagacggtgaccagggttccctggccccaggggtcgaaccagtcgacgacactctagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgacactctagtaccgactgagcgggctggcaaggc

SEQ ID NO: 2305 - DNA, 495 bp, Artificial Sequence
  Oligonucleotide
gcctccctcgcgccatcaggacactctatccatggctggcaagctgagtctccctaagtggactcagagagggggtggtgaggactcacctgaggagacggtgaccagggttccctggccccaggggtcgaaccagtcgacgacactctatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgacactctatccatggctgagcgggctggcaaggc

SEQ ID NO: 2306 - DNA, 495 bp, Artificial Sequence
  Oligonucleotide
gcctccctcgcgccatcaggacactctgtagcagtctggcaagctgagtctccctaagtggactcagagagggggtggtgaggactcacctgaggagacggtgaccagggttccctggccccaggggtcgaaccagtcgacgacactctgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgacactctgtagcagtctgagcgggctggcaaggc

SEQ ID NO: 2307 - DNA, 495 bp, Artificial Sequence
  Oligonucleotide
gcctccctcgcgccatcaggacactctatcttcgtctggcaagctgagtctccctaagtggactcagagagggggtggtgaggactcacctgaggagacggtgaccagggttccctggccccaggggtcgaaccagtcgacgacactctatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgacactctatcttcgtctgagcgggctggcaaggc

SEQ ID NO: 2308 - DNA, 495 bp, Artificial Sequence
  Oligonucleotide
gcctccctcgcgccatcaggacactcttccacagtctggcaagctgagtctccctaagtggactcagagagggggtggtgaggactcacctgaggagacggtgaccagggttccctggccccaggggtcgaaccagtcgacgacactcttccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgacactcttccacagtctgagcgggctggcaaggc

SEQ ID NO: 2309 - DNA, 495 bp, Artificial Sequence
  Oligonucleotide
gcctccctcgcgccatcaggacactctagctagtgctggcaagctgagtctccctaagtggactcagagagggggtggtgaggactcacctgaggagacggtgaccagggttccctggccccaggggtcgaaccagtcgacgacactctagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgacactctagctagtgctgagcgggctggcaaggc

SEQ ID NO: 2310 - DNA, 495 bp, Artificial Sequence
  Oligonucleotide
gcctccctcgcgccatcaggacactcttaaccaagctggcaagctgagtctccctaagtggactcagagagggggtggtgaggactcacctgaggagacggtgaccagggttccctggccccaggggtcgaaccagtcgacgacactcttaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgacactcttaaccaagctgagcgggctggcaaggc

SEQ ID NO: 2311 - DNA, 495 bp, Artificial Sequence
  Oligonucleotide
gcctccctcgcgccatcaggacactctcaagaggtctggcaagctgagtctccctaagtggactcagagagggggtggtgaggactcacctgaggagacggtgaccagggttccctggccccaggggtcgaaccagtcgacgacactctcaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgacactctcaagaggtctgagcgggctggcaaggc

SEQ ID NO: 2312 - DNA, 495 bp, Artificial Sequence
  Oligonucleotide
gcctccctcgcgccatcaggacactctagttgaccctggcaagctgagtctccctaagtggactcagagagggggtggtgaggactcacctgaggagacggtgaccagggttccctggccccaggggtcgaaccagtcgacgacactctagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagacactctagttgaccctgagcgggctggcaaggc

SEQ ID NO: 2313 - DNA, 495 bp, Artificial Sequence
  Oligonucleotide
gcctccctcgcgccatcaggacactctcagcatatctggcaagctgagtctccctaagtggactcagagagggggtggtgaggactcacctgaggagacggtgaccagggttccctggccccaggggtcgaaccagtcgacgacactctcagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagacactctcagcatatctgagcgggctggcaaggc

SEQ ID NO: 2314 - DNA, 495 bp, Artificial Sequence
  Oligonucleotide
gcctccctcgcgccatcaggacactctgcaggattctggcaagctgagtctccctaagtggactcagagagggggtggtgaggactcacctgaggagacggtgaccagggttccctggccccaggggtcgaaccagtcgacgacactctgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagacactctgcaggattctgagcgggctggcaaggc

SEQ ID NO: 2315 - DNA, 495 bp, Artificial Sequence
  Oligonucleotide
gcctccctcgcgccatcaggacactctgtccattcctggcaagctgagtctccctaagtggactcagagagggggtggtgaggactcacctgaggagacggtgaccagggttccctggccccaggggtcgaaccagtcgacgacactctgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgacactctgtccattcctgagcgggctggcaaggc

SEQ ID NO: 2316 - DNA, 495 bp, Artificial Sequence
  Oligonucleotide
gcctccctcgcgccatcaggacactctgcataactctggcaagctgagtctccctaagtggactcagagagggggtggtgaggactcacctgaggagacggtgaccagggttccctggccccaggggtcgaaccagtcgacgacactctgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgacactctgcataactctgagcgggctggcaaggc

SEQ ID NO: 2317 - DNA, 495 bp, Artificial Sequence
  Oligonucleotide
gcctccctcgcgccatcaggacactctatatgctgctggcaagctgagtctccctaagtggactcagagagggggtggtgaggactcacctgaggagacggtgaccagggttccctggccccaggggtcgaaccagtcgacgacactctatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgacactctatatgctgctgagcgggctggcaaggc

SEQ ID NO: 2318 - DNA, 495 bp, Artificial Sequence
  Oligonucleotide
gcctccctcgcgccatcaggacactctaatcctgcctggcaagctgagtctccctaagtggactcagagagggggtggtgaggactcacctgaggagacggtgaccagggttccctggccccaggggtcgaaccagtcgacgacactctaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgacactctaatcctgcctgagcgggctggcaaggc

SEQ ID NO: 2319 - DNA, 495 bp, Artificial Sequence
  Oligonucleotide
gcctccctcgcgccatcaggacactcttgagacctctggcaagctgagtctccctaagtggactcagagagggggtggtgaggactcacctgaggagacggtgaccagggttccctggccccaggggtcgaaccagtcgacgacactcttgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggacactcttgagacctctgagcgggctggcaaggc

SEQ ID NO: 2320 - DNA, 495 bp, Artificial Sequence
  Oligonucleotide
gcctccctcgcgccatcaggacactctgaatggacctggcaagctgagtctccctaagtggactcagagagggggtggtgaggactcacctgaggagacggtgaccagggttccctggccccaggggtcgaaccagtcgacgacactctgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgacactctgaatggacctgagcgggctggcaaggc

SEQ ID NO: 2321 - DNA, 495 bp, Artificial Sequence
  Oligonucleotide
gcctccctcgcgccatcaggacactctcacatggactggcaagctgagtctccctaagtggactcagagagggggtggtgaggactcacctgaggagacggtgaccagggttccctggccccaggggtcgaaccagtcgacgacactctcacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgacactctcacatggactgagcgggctggcaaggc

SEQ ID NO: 2322 - DNA, 495 bp, Artificial Sequence
  Oligonucleotide
gcctccctcgcgccatcaggacactctttgaccatctggcaagctgagtctccctaagtggactcagagagggggtggtgaggactcacctgaggagacggtgaccagggttccctggccccaggggtcgaaccagtcgacgacactctttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgacactctttgaccatctgagcgggctggcaaggc

SEQ ID NO: 2323 - DNA, 495 bp, Artificial Sequence
  Oligonucleotide
gcctccctcgcgccatcaggacactctaagccatcctggcaagctgagtctccctaagtggactcagagagggggtggtgaggactcacctgaggagacggtgaccagggttccctggccccaggggtcgaaccagtcgacgacactctaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgacactctaagccatcctgagcgggctggcaaggc

SEQ ID NO: 2324 - DNA, 495 bp, Artificial Sequence
  Oligonucleotide
gcctccctcgcgccatcaggacactcttccatgtgctggcaagctgagtctccctaagtggactcagagagggggtggtgaggactcacctgaggagacggtgaccagggttccctggccccaggggtcgaaccagtcgacgacactcttccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgacactcttccatgtgctgagcgggctggcaaggc

SEQ ID NO: 2325 - DNA, 495 bp, Artificial Sequence
  Oligonucleotide
gcctccctcgcgccatcaggacactctcaagtcacctggcaagctgagtctccctaagtggactcagagagggggtggtgaggactcacctgaggagacggtgaccagggttccctggccccaggggtcgaaccagtcgacgacactctcaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgacactctcaagtcacctgagcgggctggcaaggc

SEQ ID NO: 2326 - DNA, 495 bp, Artificial Sequence
  Oligonucleotide
gcctccctcgcgccatcaggacactctctgcaatcctggcaagctgagtctccctaagtggactcagagagggggtggtgaggactcacctgaggagacggtgaccagggttccctggccccaggggtcgaaccagtcgacgacactctctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgacactctctgcaatcctgagcgggctggcaaggc

SEQ ID NO: 2327 - DNA, 495 bp, Artificial Sequence
  Oligonucleotide
gcctccctcgcgccatcaggacactctatcgacgactggcaagctgagtctccctaagtggactcagagagggggtggtgaggactcacctgaggagacggtgaccagggttccctggccccaggggtcgaaccagtcgacgacactctatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgacactctatcgacgactgagcgggctggcaaggc

SEQ ID NO: 2328 - DNA, 495 bp, Artificial Sequence
  Oligonucleotide
gcctccctcgcgccatcaggacactctacagactgctggcaagctgagtctccctaagtggactcagagagggggtggtgaggactcacctgaggagacggtgaccagggttccctggccccaggggtcgaaccagtcgacgacactctacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagacactctacagactgctgagcgggctggcaaggc

SEQ ID NO: 2329 - DNA, 495 bp, Artificial Sequence
  Oligonucleotide
gcctccctcgcgccatcaggacactctccttatagctggcaagctgagtctccctaagtggactcagagagggggtggtgaggactcacctgaggagacggtgaccagggttccctggccccaggggtcgaaccagtcgacgacactctccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgacactctccttatagctgagcgggctggcaaggc

SEQ ID NO: 2330 - DNA, 495 bp, Artificial Sequence
  Oligonucleotide
gcctccctcgcgccatcaggacactcttacgcgttctggcaagctgagtctccctaagtggactcagagagggggtggtgaggactcacctgaggagacggtgaccagggttccctggccccaggggtcgaaccagtcgacgacactcttacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgacactcttacgcgttctgagcgggctggcaaggc

SEQ ID NO: 2331 - DNA, 495 bp, Artificial Sequence
  Oligonucleotide
gcctccctcgcgccatcaggacactctctataaggctggcaagctgagtctccctaagtggactcagagagggggtggtgaggactcacctgaggagacggtgaccagggttccctggccccaggggtcgaaccagtcgacgacactctctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggacactctctataaggctgagcgggctggcaaggc

SEQ ID NO: 2332 - DNA, 495 bp, Artificial Sequence
  Oligonucleotide
gcctccctcgcgccatcaggacactcttcttagtcctggcaagctgagtctccctaagtggactcagagagggggtggtgaggactcacctgaggagacggtgaccagggttccctggccccaggggtcgaaccagtcgacgacactcttcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgacactcttcttagtcctgagcgggctggcaaggc

SEQ ID NO: 2333 - DNA, 495 bp, Artificial Sequence
  Oligonucleotide
gcctccctcgcgccatcaggacactcttgtctgcactggcaagctgagtctccctaagtggactcagagagggggtggtgaggactcacctgaggagacggtgaccagggttccctggccccaggggtcgaaccagtcgacgacactcttgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgacactcttgtctgcactgagcgggctggcaaggc

SEQ ID NO: 2334 - DNA, 495 bp, Artificial Sequence
  Oligonucleotide
gcctccctcgcgccatcaggacactctgccattaactggcaagctgagtctccctaagtggactcagagagggggtggtgaggactcacctgaggagacggtgaccagggttccctggccccaggggtcgaaccagtcgacgacactctgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgacactctgccattaactgagcgggctggcaaggc

SEQ ID NO: 2335 - DNA, 495 bp, Artificial Sequence
  Oligonucleotide
gcctccctcgcgccatcaggacactctgactaagactggcaagctgagtctccctaagtggactcagagagggggtggtgaggactcacctgaggagacggtgaccagggttccctggccccaggggtcgaaccagtcgacgacactctgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggacactctgactaagactgagcgggctggcaaggc

SEQ ID NO: 2336 - DNA, 495 bp, Artificial Sequence
  Oligonucleotide
gcctccctcgcgccatcaggacactctaggttgctctggcaagctgagtctccctaagtggactcagagagggggtggtgaggactcacctgaggagacggtgaccagggttccctggccccaggggtcgaaccagtcgacgacactctaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggacactctaggttgctctgagcgggctggcaaggc

SEQ ID NO: 2337 - DNA, 495 bp, Artificial Sequence
  Oligonucleotide
gcctccctcgcgccatcaggacactctctcgagaactggcaagctgagtctccctaagtggactcagagagggggtggtgaggactcacctgaggagacggtgaccagggttccctggccccaggggtcgaaccagtcgacgacactctctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgacactctctcgagaactgagcgggctggcaaggc

SEQ ID NO: 2338 - DNA, 495 bp, Artificial Sequence
  Oligonucleotide
gcctccctcgcgccatcaggacactctttaatggcctggcaagctgagtctccctaagtggactcagagagggggtggtgaggactcacctgaggagacggtgaccagggttccctggccccaggggtcgaaccagtcgacgacactctttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgacactctttaatggcctgagcgggctggcaaggc

SEQ ID NO: 2339 - DNA, 495 bp, Artificial Sequence
  Oligonucleotide
gcctccctcgcgccatcaggacactcttgcagacactggcaagctgagtctccctaagtggactcagagagggggtggtgaggactcacctgaggagacggtgaccagggttccctggccccaggggtcgaaccagtcgacgacactcttgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagacactcttgcagacactgagcgggctggcaaggc

SEQ ID NO: 2340 - DNA, 495 bp, Artificial Sequence
  Oligonucleotide
gcctccctcgcgccatcaggacactcttcactgagctggcaagctgagtctccctaagtggactcagagagggggtggtgaggactcacctgaggagacggtgaccagggttccctggccccaggggtcgaaccagtcgacgacactcttcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgacactcttcactgagctgagcgggctggcaaggc

SEQ ID NO: 2341 - DNA, 495 bp, Artificial Sequence
  Oligonucleotide
gcctccctcgcgccatcaggacactctgagtacgtctggcaagctgagtctccctaagtggactcagagagggggtggtgaggactcacctgaggagacggtgaccagggttccctggccccaggggtcgaaccagtcgacgacactctgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgacactctgagtacgtctgagcgggctggcaaggc

SEQ ID NO: 2342 - DNA, 495 bp, Artificial Sequence
  Oligonucleotide
gcctccctcgcgccatcaggacactctatacgccactggcaagctgagtctccctaagtggactcagagagggggtggtgaggactcacctgaggagacggtgaccagggttccctggccccaggggtcgaaccagtcgacgacactctatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgacactctatacgccactgagcgggctggcaaggc

SEQ ID NO: 2343 - DNA, 495 bp, Artificial Sequence
  Oligonucleotide
gcctccctcgcgccatcaggacactcttcgcatcactggcaagctgagtctccctaagtggactcagagagggggtggtgaggactcacctgaggagacggtgaccagggttccctggccccaggggtcgaaccagtcgacgacactcttcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgacactcttcgcatcactgagcgggctggcaaggc

SEQ ID NO: 2344 - DNA, 495 bp, Artificial Sequence
  Oligonucleotide
gcctccctcgcgccatcaggacactctcgcttaatctggcaagctgagtctccctaagtggactcagagagggggtggtgaggactcacctgaggagacggtgaccagggttccctggccccaggggtcgaaccagtcgacgacactctcgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgacactctcgcttaatctgagcgggctggcaaggc

SEQ ID NO: 2345 - DNA, 495 bp, Artificial Sequence
  Oligonucleotide
gcctccctcgcgccatcaggacactcttggttatcctggcaagctgagtctccctaagtggactcagagagggggtggtgaggactcacctgaggagacggtgaccagggttccctggccccaggggtcgaaccagtcgacgacactcttggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgacactcttggttatcctgagcgggctggcaaggc

SEQ ID NO: 2346 - DNA, 495 bp, Artificial Sequence
  Oligonucleotide
gcctccctcgcgccatcaggacactctggattgctctggcaagctgagtctccctaagtggactcagagagggggtggtgaggactcacctgaggagacggtgaccagggttccctggccccaggggtcgaaccagtcgacgacactctggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgacactctggattgctctgagcgggctggcaaggc

SEQ ID NO: 2347 - DNA, 495 bp, Artificial Sequence
  Oligonucleotide
gcctccctcgcgccatcaggacactctctcagtgactggcaagctgagtctccctaagtggactcagagagggggtggtgaggactcacctgaggagacggtgaccagggttccctggccccaggggtcgaaccagtcgacgacactctctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgacactctctcagtgactgagcgggctggcaaggc

SEQ ID NO: 2348 - DNA, 495 bp, Artificial Sequence
  Oligonucleotide
gcctccctcgcgccatcaggacactctacgtactcctggcaagctgagtctccctaagtggactcagagagggggtggtgaggactcacctgaggagacggtgaccagggttccctggccccaggggtcgaaccagtcgacgacactctacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgacactctacgtactcctgagcgggctggcaaggc

SEQ ID NO: 2349 - DNA, 495 bp, Artificial Sequence
  Oligonucleotide
gcctccctcgcgccatcaggacactcttgatgcgactggcaagctgagtctccctaagtggactcagagagggggtggtgaggactcacctgaggagacggtgaccagggttccctggccccaggggtcgaaccagtcgacgacactcttgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgacactcttgatgcgactgagcgggctggcaaggc

SEQ ID NO: 2350 - DNA, 495 bp, Artificial Sequence
  Oligonucleotide
gcctccctcgcgccatcaggacactctattaagcgctggcaagctgagtctccctaagtggactcagagagggggtggtgaggactcacctgaggagacggtgaccagggttccctggccccaggggtcgaaccagtcgacgacactctattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgacactctattaagcgctgagcgggctggcaaggc

SEQ ID NO: 2351 - DNA, 495 bp, Artificial Sequence
  Oligonucleotide
gcctccctcgcgccatcaggacactctagcaatccctggcaagctgagtctccctaagtggactcagagagggggtggtgaggactcacctgaggagacggtgaccagggttccctggccccaggggtcgaaccagtcgacgacactctagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgacactctagcaatccctgagcgggctggcaaggc

SEQ ID NO: 2352 - DNA, 495 bp, Artificial Sequence
  Oligonucleotide
gcctccctcgcgccatcaggacactctgcttagtactggcaagctgagtctccctaagtggactcagagagggggtggtgaggactcacctgaggagacggtgaccagggttccctggccccaggggtcgaaccagtcgacgacactctgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagacactctgcttagtactgagcgggctggcaaggc

SEQ ID NO: 2353 - DNA, 495 bp, Artificial Sequence
  Oligonucleotide
gcctccctcgcgccatcaggacactcttgaccttgctggcaagctgagtctccctaagtggactcagagagggggtggtgaggactcacctgaggagacggtgaccagggttccctggccccaggggtcgaaccagtcgacgacactcttgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgacactcttgaccttgctgagcgggctggcaaggc

SEQ ID NO: 2354 - DNA, 495 bp, Artificial Sequence
  Oligonucleotide
gcctccctcgcgccatcaggacactctcaaggtcactggcaagctgagtctccctaagtggactcagagagggggtggtgaggactcacctgaggagacggtgaccagggttccctggccccaggggtcgaaccagtcgacgacactctcaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgacactctcaaggtcactgagcgggctggcaaggc

SEQ ID NO: 2355 - DNA, 495 bp, Artificial Sequence
  Oligonucleotide
gcctccctcgcgccatcaggacactctcactgtacctggcaagctgagtctccctaagtggactcagagagggggtggtgaggactcacctgaggagacggtgaccagggttccctggccccaggggtcgaaccagtcgacgacactctcactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgacactctcactgtacctgagcgggctggcaaggc

SEQ ID NO: 2356 - DNA, 495 bp, Artificial Sequence
  Oligonucleotide
gcctccctcgcgccatcaggacactctgatgatccctggcaagctgagtctccctaagtggactcagagagggggtggtgaggactcacctgaggagacggtgaccagggttccctggccccaggggtcgaaccagtcgacgacactctgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggacactctgatgatccctgagcgggctggcaaggc

SEQ ID NO: 2357 - DNA, 495 bp, Artificial Sequence
  Oligonucleotide
gcctccctcgcgccatcaggacactctcgccaatactggcaagctgagtctccctaagtggactcagagagggggtggtgaggactcacctgaggagacggtgaccagggttccctggccccaggggtcgaaccagtcgacgacactctcgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggacactctcgccaatactgagcgggctggcaaggc

SEQ ID NO: 2358 - DNA, 495 bp, Artificial Sequence
  Oligonucleotide
gcctccctcgcgccatcaggacactcttcaagcctctggcaagctgagtctccctaagtggactcagagagggggtggtgaggactcacctgaggagacggtgaccagggttccctggccccaggggtcgaaccagtcgacgacactcttcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagacactcttcaagcctctgagcgggctggcaaggc

SEQ ID NO: 2359 - DNA, 495 bp, Artificial Sequence
  Oligonucleotide
gcctccctcgcgccatcaggacactctacgtgtgtctggcaagctgagtctccctaagtggactcagagagggggtggtgaggactcacctgaggagacggtgaccagggttccctggccccaggggtcgaaccagtcgacgacactctacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggacactctacgtgtgtctgagcgggctggcaaggc

SEQ ID NO: 2360 - DNA, 495 bp, Artificial Sequence
  Oligonucleotide
gcctccctcgcgccatcaggacactcttccgtctactggcaagctgagtctccctaagtggactcagagagggggtggtgaggactcacctgaggagacggtgaccagggttccctggccccaggggtcgaaccagtcgacgacactcttccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggacactcttccgtctactgagcgggctggcaaggc

SEQ ID NO: 2361 - DNA, 495 bp, Artificial Sequence
  Oligonucleotide
gcctccctcgcgccatcaggacactctaagagctgctggcaagctgagtctccctaagtggactcagagagggggtggtgaggactcacctgaggagacggtgaccagggttccctggccccaggggtcgaaccagtcgacgacactctaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggacactctaagagctgctgagcgggctggcaaggc

SEQ ID NO: 2362 - DNA, 495 bp, Artificial Sequence
  Oligonucleotide
gcctccctcgcgccatcaggacactcttatcgctcctggcaagctgagtctccctaagtggactcagagagggggtggtgaggactcacctgaggagacggtgaccagggttccctggccccaggggtcgaaccagtcgacgacactcttatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggacactcttatcgctcctgagcgggctggcaaggc

SEQ ID NO: 2363 - DNA, 495 bp, Artificial Sequence
  Oligonucleotide
gcctccctcgcgccatcaggacactcttcagatgcctggcaagctgagtctccctaagtggactcagagagggggtggtgaggactcacctgaggagacggtgaccagggttccctggccccaggggtcgaaccagtcgacgacactcttcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgacactcttcagatgcctgagcgggctggcaaggc

SEQ ID NO: 2364 - DNA, 495 bp, Artificial Sequence
  Oligonucleotide
gcctccctcgcgccatcaggacactctgtgtagcactggcaagctgagtctccctaagtggactcagagagggggtggtgaggactcacctgaggagacggtgaccagggttccctggccccaggggtcgaaccagtcgacgacactctgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggacactctgtgtagcactgagcgggctggcaaggc

SEQ ID NO: 2365 - DNA, 495 bp, Artificial Sequence
  Oligonucleotide
gcctccctcgcgccatcaggacactcttggcagttctggcaagctgagtctccctaagtggactcagagagggggtggtgaggactcacctgaggagacggtgaccagggttccctggccccaggggtcgaaccagtcgacgacactcttggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggacactcttggcagttctgagcgggctggcaaggc

SEQ ID NO: 2366 - DNA, 495 bp, Artificial Sequence
  Oligonucleotide
gcctccctcgcgccatcaggacactctcagtccaactggcaagctgagtctccctaagtggactcagagagggggtggtgaggactcacctgaggagacggtgaccagggttccctggccccaggggtcgaaccagtcgacgacactctcagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgacactctcagtccaactgagcgggctggcaaggc

SEQ ID NO: 2367 - DNA, 495 bp, Artificial Sequence
  Oligonucleotide
gcctccctcgcgccatcaggacactctgtgtctacctggcaagctgagtctccctaagtggactcagagagggggtggtgaggactcacctgaggagacggtgaccagggttccctggccccaggggtcgaaccagtcgacgacactctgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggacactctgtgtctacctgagcgggctggcaaggc

SEQ ID NO: 2368 - DNA, 495 bp, Artificial Sequence
  Oligonucleotide
gcctccctcgcgccatcaggacactctgtacagtgctggcaagctgagtctccctaagtggactcagagagggggtggtgaggactcacctgaggagacggtgaccagggttccctggccccaggggtcgaaccagtcgacgacactctgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggacactctgtacagtgctgagcgggctggcaaggc

SEQ ID NO: 2369 - DNA, 495 bp, Artificial Sequence
  Oligonucleotide
gcctccctcgcgccatcaggacactctggatcatcctggcaagctgagtctccctaagtggactcagagagggggtggtgaggactcacctgaggagacggtgaccagggttccctggccccaggggtcgaaccagtcgacgacactctggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggacactctggatcatcctgagcgggctggcaaggc

SEQ ID NO: 2370 - DNA, 495 bp, Artificial Sequence
  Oligonucleotide
gcctccctcgcgccatcaggacactcttattggcgctggcaagctgagtctccctaagtggactcagagagggggtggtgaggactcacctgaggagacggtgaccagggttccctggccccaggggtcgaaccagtcgacgacactcttattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagacactcttattggcgctgagcgggctggcaaggc

SEQ ID NO: 2371 - DNA, 495 bp, Artificial Sequence
  Oligonucleotide
gcctccctcgcgccatcaggacactctaggcttgactggcaagctgagtctccctaagtggactcagagagggggtggtgaggactcacctgaggagacggtgaccagggttccctggccccaggggtcgaaccagtcgacgacactctaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgacactctaggcttgactgagcgggctggcaaggc

SEQ ID NO: 2372 - DNA, 495 bp, Artificial Sequence
  Oligonucleotide
gcctccctcgcgccatcaggacactctacacacgtctggcaagctgagtctccctaagtggactcagagagggggtggtgaggactcacctgaggagacggtgaccagggttccctggccccaggggtcgaaccagtcgacgacactctacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgacactctacacacgtctgagcgggctggcaaggc

SEQ ID NO: 2373 - DNA, 495 bp, Artificial Sequence
  Oligonucleotide
gcctccctcgcgccatcaggacactcttagacggactggcaagctgagtctccctaagtggactcagagagggggtggtgaggactcacctgaggagacggtgaccagggttccctggccccaggggtcgaaccagtcgacgacactcttagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagacactcttagacggactgagcgggctggcaaggc

SEQ ID NO: 2374 - DNA, 495 bp, Artificial Sequence
  Oligonucleotide
gcctccctcgcgccatcaggacactctgagcgatactggcaagctgagtctccctaagtggactcagagagggggtggtgaggactcacctgaggagacggtgaccagggttccctggccccaggggtcgaaccagtcgacgacactctgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgacactctgagcgatactgagcgggctggcaaggc

SEQ ID NO: 2375 - DNA, 495 bp, Artificial Sequence
  Oligonucleotide
gcctccctcgcgccatcaggacactctgcatctgactggcaagctgagtctccctaagtggactcagagagggggtggtgaggactcacctgaggagacggtgaccagggttccctggccccaggggtcgaaccagtcgacgacactctgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagacactctgcatctgactgagcgggctggcaaggc

SEQ ID NO: 2376 - DNA, 495 bp, Artificial Sequence
  Oligonucleotide
gcctccctcgcgccatcaggacactcttgctacacctggcaagctgagtctccctaagtggactcagagagggggtggtgaggactcacctgaggagacggtgaccagggttccctggccccaggggtcgaaccagtcgacgacactcttgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggacactcttgctacacctgagcgggctggcaaggc

SEQ ID NO: 2377 - DNA, 495 bp, Artificial Sequence
  Oligonucleotide
gcctccctcgcgccatcaggacactctaactgccactggcaagctgagtctccctaagtggactcagagagggggtggtgaggactcacctgaggagacggtgaccagggttccctggccccaggggtcgaaccagtcgacgacactctaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgacactctaactgccactgagcgggctggcaaggc

SEQ ID NO: 2378 - DNA, 495 bp, Artificial Sequence
  Oligonucleotide
gcctccctcgcgccatcaggacactctttggactgctggcaagctgagtctccctaagtggactcagagagggggtggtgaggactcacctgaggagacggtgaccagggttccctggccccaggggtcgaaccagtcgacgacactctttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggacactctttggactgctgagcgggctggcaaggc

SEQ ID NO: 2379 - DNA, 495 bp, Artificial Sequence
  Oligonucleotide
gcctccctcgcgccatcaggacactcttcggtactctggcaagctgagtctccctaagtggactcagagagggggtggtgaggactcacctgaggagacggtgaccagggttccctggccccaggggtcgaaccagtcgacgacactcttcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggacactcttcggtactctgagcgggctggcaaggc

SEQ ID NO: 2380 - DNA, 495 bp, Artificial Sequence
  Oligonucleotide
gcctccctcgcgccatcaggacactctccatggatctggcaagctgagtctccctaagtggactcagagagggggtggtgaggactcacctgaggagacggtgaccagggttccctggccccaggggtcgaaccagtcgacgacactctccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgacactctccatggatctgagcgggctggcaaggc

SEQ ID NO: 2381 - DNA, 495 bp, Artificial Sequence
  Oligonucleotide
gcctccctcgcgccatcaggacactctacgaagatctggcaagctgagtctccctaagtggactcagagagggggtggtgaggactcacctgaggagacggtgaccagggttccctggccccaggggtcgaaccagtcgacgacactctacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagacactctacgaagatctgagcgggctggcaaggc

SEQ ID NO: 2382 - DNA, 495 bp, Artificial Sequence
  Oligonucleotide
gcctccctcgcgccatcaggacactctactgtggactggcaagctgagtctccctaagtggactcagagagggggtggtgaggactcacctgaggagacggtgaccagggttccctggccccaggggtcgaaccagtcgacgacactctactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgacactctactgtggactgagcgggctggcaaggc

SEQ ID NO: 2383 - DNA, 495 bp, Artificial Sequence
  Oligonucleotide
gcctccctcgcgccatcaggacactctggtgtcatctggcaagctgagtctccctaagtggactcagagagggggtggtgaggactcacctgaggagacggtgaccagggttccctggccccaggggtcgaaccagtcgacgacactctggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgacactctggtgtcatctgagcgggctggcaaggc

SEQ ID NO: 2384 - DNA, 495 bp, Artificial Sequence
  Oligonucleotide
gcctccctcgcgccatcaggacactcttcgtgaagctggcaagctgagtctccctaagtggactcagagagggggtggtgaggactcacctgaggagacggtgaccagggttccctggccccaggggtcgaaccagtcgacgacactcttcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggacactcttcgtgaagctgagcgggctggcaaggc

SEQ ID NO: 2385 - DNA, 495 bp, Artificial Sequence
  Oligonucleotide
gcctccctcgcgccatcaggacactctcactagctctggcaagctgagtctccctaagtggactcagagagggggtggtgaggactcacctgaggagacggtgaccagggttccctggccccaggggtcgaaccagtcgacgacactctcactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagacactctcactagctctgagcgggctggcaaggc

SEQ ID NO: 2386 - DNA, 495 bp, Artificial Sequence
  Oligonucleotide
gcctccctcgcgccatcaggacactctggtcaactctggcaagctgagtctccctaagtggactcagagagggggtggtgaggactcacctgaggagacggtgaccagggttccctggccccaggggtcgaaccagtcgacgacactctggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagacactctggtcaactctgagcgggctggcaaggc

SEQ ID NO: 2387 - DNA, 495 bp, Artificial Sequence
  Oligonucleotide
gcctccctcgcgccatcaggacactcttacgtacgctggcaagctgagtctccctaagtggactcagagagggggtggtgaggactcacctgaggagacggtgaccagggttccctggccccaggggtcgaaccagtcgacgacactcttacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgacactcttacgtacgctgagcgggctggcaaggc

SEQ ID NO: 2388 - DNA, 495 bp, Artificial Sequence
  Oligonucleotide
gcctccctcgcgccatcaggacactctatgacaccctggcaagctgagtctccctaagtggactcagagagggggtggtgaggactcacctgaggagacggtgaccagggttccctggccccaggggtcgaaccagtcgacgacactctatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggacactctatgacaccctgagcgggctggcaaggc

SEQ ID NO: 2389 - DNA, 495 bp, Artificial Sequence
  Oligonucleotide
gcctccctcgcgccatcaggacactctcttcacgactggcaagctgagtctccctaagtggactcagagagggggtggtgaggactcacctgaggagacggtgaccagggttccctggccccaggggtcgaaccagtcgacgacactctcttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgacactctcttcacgactgagcgggctggcaaggc

SEQ ID NO: 2390 - DNA, 495 bp, Artificial Sequence
  Oligonucleotide
gcctccctcgcgccatcaggacactctagaatcagctggcaagctgagtctccctaagtggactcagagagggggtggtgaggactcacctgaggagacggtgaccagggttccctggccccaggggtcgaaccagtcgacgacactctagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgacactctagaatcagctgagcgggctggcaaggc

SEQ ID NO: 2391 - DNA, 495 bp, Artificial Sequence
  Oligonucleotide
gcctccctcgcgccatcaggacactctagttatgcctggcaagctgagtctccctaagtggactcagagagggggtggtgaggactcacctgaggagacggtgaccagggttccctggccccaggggtcgaaccagtcgacgacactctagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagacactctagttatgcctgagcgggctggcaaggc

SEQ ID NO: 2392 - DNA, 495 bp, Artificial Sequence
  Oligonucleotide
gcctccctcgcgccatcaggacactctaggtctcactggcaagctgagtctccctaagtggactcagagagggggtggtgaggactcacctgaggagacggtgaccagggttccctggccccaggggtcgaaccagtcgacgacactctaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgacactctaggtctcactgagcgggctggcaaggc

SEQ ID NO: 2393 - DNA, 495 bp, Artificial Sequence
  Oligonucleotide
gcctccctcgcgccatcaggacactctgtcatagtctggcaagctgagtctccctaagtggactcagagagggggtggtgaggactcacctgaggagacggtgaccagggttccctggccccaggggtcgaaccagtcgacgacactctgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgacactctgtcatagtctgagcgggctggcaaggc

SEQ ID NO: 2394 - DNA, 495 bp, Artificial Sequence
  Oligonucleotide
gcctccctcgcgccatcaggacactctgtgacttgctggcaagctgagtctccctaagtggactcagagagggggtggtgaggactcacctgaggagacggtgaccagggttccctggccccaggggtcgaaccagtcgacgacactctgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggacactctgtgacttgctgagcgggctggcaaggc

SEQ ID NO: 2395 - DNA, 495 bp, Artificial Sequence
  Oligonucleotide
gcctccctcgcgccatcaggacactctgattgcagctggcaagctgagtctccctaagtggactcagagagggggtggtgaggactcacctgaggagacggtgaccagggttccctggccccaggggtcgaaccagtcgacgacactctgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgacactctgattgcagctgagcgggctggcaaggc

SEQ ID NO: 2396 - DNA, 495 bp, Artificial Sequence
  Oligonucleotide
gcctccctcgcgccatcaggacactctactatgacctggcaagctgagtctccctaagtggactcagagagggggtggtgaggactcacctgaggagacggtgaccagggttccctggccccaggggtcgaaccagtcgacgacactctactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgacactctactatgacctgagcgggctggcaaggc

SEQ ID NO: 2397 - DNA, 495 bp, Artificial Sequence
  Oligonucleotide
gcctccctcgcgccatcaggacactctatggtcaactggcaagctgagtctccctaagtggactcagagagggggtggtgaggactcacctgaggagacggtgaccagggttccctggccccaggggtcgaaccagtcgacgacactctatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgacactctatggtcaactgagcgggctggcaaggc

SEQ ID NO: 2398 - DNA, 495 bp, Artificial Sequence
  Oligonucleotide
gcctccctcgcgccatcaggacactctgatggcttctggcaagctgagtctccctaagtggactcagagagggggtggtgaggactcacctgaggagacggtgaccagggttccctggccccaggggtcgaaccagtcgacgacactctgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgacactctgatggcttctgagcgggctggcaaggc

SEQ ID NO: 2399 - DNA, 495 bp, Artificial Sequence
  Oligonucleotide
gcctccctcgcgccatcaggacactctagcatatgctggcaagctgagtctccctaagtggactcagagagggggtggtgaggactcacctgaggagacggtgaccagggttccctggccccaggggtcgaaccagtcgacgacactctagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgacactctagcatatgctgagcgggctggcaaggc

SEQ ID NO: 2400 - DNA, 495 bp, Artificial Sequence
  Oligonucleotide
gcctccctcgcgccatcaggacactctcatatgctctggcaagctgagtctccctaagtggactcagagagggggtggtgaggactcacctgaggagacggtgaccagggttccctggccccaggggtcgaaccagtcgacgacactctcatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggacactctcatatgctctgagcgggctggcaaggc

SEQ ID NO: 2401 - DNA, 495 bp, Artificial Sequence
  Oligonucleotide
gcctccctcgcgccatcaggacactcttcgtcgatctggcaagctgagtctccctaagtggactcagagagggggtggtgaggactcacctgaggagacggtgaccagggttccctggccccaggggtcgaaccagtcgacgacactcttcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgacactcttcgtcgatctgagcgggctggcaaggc

SEQ ID NO: 2402 - DNA, 495 bp, Artificial Sequence
  Oligonucleotide
gcctccctcgcgccatcaggacactctcagtctgtctggcaagctgagtctccctaagtggactcagagagggggtggtgaggactcacctgaggagacggtgaccagggttccctggccccaggggtcgaaccagtcgacgacactctcagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgacactctcagtctgtctgagcgggctggcaaggc

SEQ ID NO: 2403 - DNA, 495 bp, Artificial Sequence
  Oligonucleotide
gcctccctcgcgccatcaggacactctaacgcgtactggcaagctgagtctccctaagtggactcagagagggggtggtgaggactcacctgaggagacggtgaccagggttccctggccccaggggtcgaaccagtcgacgacactctaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggacactctaacgcgtactgagcgggctggcaaggc

SEQ ID NO: 2404 - DNA, 495 bp, Artificial Sequence
  Oligonucleotide
gcctccctcgcgccatcaggacactctgtagttcgctggcaagctgagtctccctaagtggactcagagagggggtggtgaggactcacctgaggagacggtgaccagggttccctggccccaggggtcgaaccagtcgacgacactctgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgacactctgtagttcgctgagcgggctggcaaggc

SEQ ID NO: 2405 - DNA, 495 bp, Artificial Sequence
  Oligonucleotide
gcctccctcgcgccatcaggacactctcgaactacctggcaagctgagtctccctaagtggactcagagagggggtggtgaggactcacctgaggagacggtgaccagggttccctggccccaggggtcgaaccagtcgacgacactctcgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgacactctcgaactacctgagcgggctggcaaggc

SEQ ID NO: 2406 - DNA, 495 bp, Artificial Sequence
  Oligonucleotide
gcctccctcgcgccatcaggacactctttaacgtcctggcaagctgagtctccctaagtggactcagagagggggtggtgaggactcacctgaggagacggtgaccagggttccctggccccaggggtcgaaccagtcgacgacactctttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgacactctttaacgtcctgagcgggctggcaaggc

SEQ ID NO: 2407 - DNA, 495 bp, Artificial Sequence
  Oligonucleotide
gcctccctcgcgccatcaggacactctagcaacctctggcaagctgagtctccctaagtggactcagagagggggtggtgaggactcacctgaggagacggtgaccagggttccctggccccaggggtcgaaccagtcgacgacactctagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgacactctagcaacctctgagcgggctggcaaggc

SEQ ID NO: 2408 - DNA, 495 bp, Artificial Sequence
  Oligonucleotide
gcctccctcgcgccatcaggacactctttctcgagctggcaagctgagtctccctaagtggactcagagagggggtggtgaggactcacctgaggagacggtgaccagggttccctggccccaggggtcgaaccagtcgacgacactctttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgacactctttctcgagctgagcgggctggcaaggc

SEQ ID NO: 2409 - DNA, 495 bp, Artificial Sequence
  Oligonucleotide
gcctccctcgcgccatcaggacactctactctacgctggcaagctgagtctccctaagtggactcagagagggggtggtgaggactcacctgaggagacggtgaccagggttccctggccccaggggtcgaaccagtcgacgacactctactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgacactctactctacgctgagcgggctggcaaggc

SEQ ID NO: 2410 - DNA, 495 bp, Artificial Sequence
  Oligonucleotide
gcctccctcgcgccatcaggacactcttaccggaactggcaagctgagtctccctaagtggactcagagagggggtggtgaggactcacctgaggagacggtgaccagggttccctggccccaggggtcgaaccagtcgacgacactcttaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgacactcttaccggaactgagcgggctggcaaggc

SEQ ID NO: 2411 - DNA, 495 bp, Artificial Sequence
  Oligonucleotide
gcctccctcgcgccatcaggacactctcgaattgcctggcaagctgagtctccctaagtggactcagagagggggtggtgaggactcacctgaggagacggtgaccagggttccctggccccaggggtcgaaccagtcgacgacactctcgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgacactctcgaattgcctgagcgggctggcaaggc

SEQ ID NO: 2412 - DNA, 495 bp, Artificial Sequence
  Oligonucleotide
gcctccctcgcgccatcaggacactctttcgctcactggcaagctgagtctccctaagtggactcagagagggggtggtgaggactcacctgaggagacggtgaccagggttccctggccccaggggtcgaaccagtcgacgacactctttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagacactctttcgctcactgagcgggctggcaaggc

SEQ ID NO: 2413 - DNA, 495 bp, Artificial Sequence
  Oligonucleotide
gcctccctcgcgccatcaggacactctgacgttaactggcaagctgagtctccctaagtggactcagagagggggtggtgaggactcacctgaggagacggtgaccagggttccctggccccaggggtcgaaccagtcgacgacactctgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggacactctgacgttaactgagcgggctggcaaggc

SEQ ID NO: 2414 - DNA, 495 bp, Artificial Sequence
  Oligonucleotide
gcctccctcgcgccatcaggacactctcgtagagtctggcaagctgagtctccctaagtggactcagagagggggtggtgaggactcacctgaggagacggtgaccagggttccctggccccaggggtcgaaccagtcgacgacactctcgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgacactctcgtagagtctgagcgggctggcaaggc

SEQ ID NO: 2415 - DNA, 495 bp, Artificial Sequence
  Oligonucleotide
gcctccctcgcgccatcaggacactctttccggtactggcaagctgagtctccctaagtggactcagagagggggtggtgaggactcacctgaggagacggtgaccagggttccctggccccaggggtcgaaccagtcgacgacactctttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgacactctttccggtactgagcgggctggcaaggc

SEQ ID NO: 2416 - DNA, 495 bp, Artificial Sequence
  Oligonucleotide
gcctccctcgcgccatcaggacactctgcaattcgctggcaagctgagtctccctaagtggactcagagagggggtggtgaggactcacctgaggagacggtgaccagggttccctggccccaggggtcgaaccagtcgacgacactctgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgacactctgcaattcgctgagcgggctggcaaggc

SEQ ID NO: 2417 - DNA, 495 bp, Artificial Sequence
  Oligonucleotide
gcctccctcgcgccatcaggacactcttgagcgaactggcaagctgagtctccctaagtggactcagagagggggtggtgaggactcacctgaggagacggtgaccagggttccctggccccaggggtcgaaccagtcgacgacactcttgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgacactcttgagcgaactgagcgggctggcaaggc

SEQ ID NO: 2418 - DNA, 495 bp, Artificial Sequence
  Oligonucleotide
gcctccctcgcgccatcaggacactcttactaagcctggcaagctgagtctccctaagtggactcagagagggggtggtgaggactcacctgaggagacggtgaccagggttccctggccccaggggtcgaaccagtcgacgacactcttactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgacactcttactaagcctgagcgggctggcaaggc

SEQ ID NO: 2419 - DNA, 495 bp, Artificial Sequence
  Oligonucleotide
gcctccctcgcgccatcaggacactcttggcgtatctggcaagctgagtctccctaagtggactcagagagggggtggtgaggactcacctgaggagacggtgaccagggttccctggccccaggggtcgaaccagtcgacgacactcttggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgacactcttggcgtatctgagcgggctggcaaggc

SEQ ID NO: 2420 - DNA, 495 bp, Artificial Sequence
  Oligonucleotide
gcctccctcgcgccatcaggacactctgataaccactggcaagctgagtctccctaagtggactcagagagggggtggtgaggactcacctgaggagacggtgaccagggttccctggccccaggggtcgaaccagtcgacgacactctgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggacactctgataaccactgagcgggctggcaaggc

SEQ ID NO: 2421 - DNA, 495 bp, Artificial Sequence
  Oligonucleotide
gcctccctcgcgccatcaggacactctctagtgaactggcaagctgagtctccctaagtggactcagagagggggtggtgaggactcacctgaggagacggtgaccagggttccctggccccaggggtcgaaccagtcgacgacactctctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggacactctctagtgaactgagcgggctggcaaggc

SEQ ID NO: 2422 - DNA, 495 bp, Artificial Sequence
  Oligonucleotide
gcctccctcgcgccatcaggacactctacgttcacctggcaagctgagtctccctaagtggactcagagagggggtggtgaggactcacctgaggagacggtgaccagggttccctggccccaggggtcgaaccagtcgacgacactctacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgacactctacgttcacctgagcgggctggcaaggc

SEQ ID NO: 2423 - DNA, 448 bp, Artificial Sequence
  Oligonucleotide
gcctccctcgcgccatcaggacactctattacgctctggcaagctgagtctccctaagtggactcagagagggggtggtgaggactcacctgaggagacggtgaccagggttccctggccccaggggtcgaaccagtcgacgacactctattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagacactctattacgctctgagcgggctggcaaggc

SEQ ID NO: 2424 - DNA, 495 bp, Artificial Sequence
  Oligonucleotide
gcctccctcgcgccatcaggacactctcattgagtctggcaagctgagtctccctaagtggactcagagagggggtggtgaggactcacctgaggagacggtgaccagggttccctggccccaggggtcgaaccagtcgacgacactctcattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgacactctcattgagtctgagcgggctggcaaggc

SEQ ID NO: 2425 - DNA, 495 bp, Artificial Sequence
  Oligonucleotide
gcctccctcgcgccatcagttcggaaccttggttaggcagtagcagaaaacaaaggccctagagtggccattcttacctgaggagacggtgaccgtggtccctttgccccagacgtccatgtagtagtagtagtagtcgacttcggaaccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccttcggaaccttggttactgagcgggctggcaaggc

SEQ ID NO: 2426 - DNA, 495 bp, Artificial Sequence
  Oligonucleotide
gcctccctcgcgccatcagttcggaacacctcttgggcagtagcagaaaacaaaggccctagagtggccattcttacctgaggagacggtgaccgtggtccctttgccccagacgtccatgtagtagtagtagtagtcgacttcggaacacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccttcggaacacctcttgctgagcgggctggcaaggc

SEQ ID NO: 2427 - DNA, 495 bp, Artificial Sequence
  Oligonucleotide
gcctccctcgcgccatcagttcggaacctgattctggcagtagcagaaaacaaaggccctagagtggccattcttacctgaggagacggtgaccgtggtccctttgccccagacgtccatgtagtagtagtagtagtcgacttcggaacctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccttcggaacctgattctctgagcgggctggcaaggc

SEQ ID NO: 2428 - DNA, 495 bp, Artificial Sequence
  Oligonucleotide
gcctccctcgcgccatcagttcggaacagtaccgaggcagtagcagaaaacaaaggccctagagtggccattcttacctgaggagacggtgaccgtggtccctttgccccagacgtccatgtagtagtagtagtagtcgacttcggaacagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccttcggaacagtaccgactgagcgggctggcaaggc

SEQ ID NO: 2429 - DNA, 495 bp, Artificial Sequence
  Oligonucleotide
gcctccctcgcgccatcagttcggaacatccatggggcagtagcagaaaacaaaggccctagagtggccattcttacctgaggagacggtgaccgtggtccctttgccccagacgtccatgtagtagtagtagtagtcgacttcggaacatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccttcggaacatccatggctgagcgggctggcaaggc

SEQ ID NO: 2430 - DNA, 495 bp, Artificial Sequence
  Oligonucleotide
gcctccctcgcgccatcagttcggaacgtagcagtggcagtagcagaaaacaaaggccctagagtggccattcttacctgaggagacggtgaccgtggtccctttgccccagacgtccatgtagtagtagtagtagtcgacttcggaacgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcttcggaacgtagcagtctgagcgggctggcaaggc

SEQ ID NO: 2431 - DNA, 495 bp, Artificial Sequence
  Oligonucleotide
gcctccctcgcgccatcagttcggaacatcttcgtggcagtagcagaaaacaaaggccctagagtggccattcttacctgaggagacggtgaccgtggtccctttgccccagacgtccatgtagtagtagtagtagtcgacttcggaacatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccttcggaacatcttcgtctgagcgggctggcaaggc

SEQ ID NO: 2432 - DNA, 495 bp, Artificial Sequence
  Oligonucleotide
gcctccctcgcgccatcagttcggaactccacagtggcagtagcagaaaacaaaggccctagagtggccattcttacctgaggagacggtgaccgtggtccctttgccccagacgtccatgtagtagtagtagtagtcgacttcggaactccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccttcggaactccacagtctgagcgggctggcaaggc

SEQ ID NO: 2433 - DNA, 495 bp, Artificial Sequence
  Oligonucleotide
gcctccctcgcgccatcagttcggaacagctagtgggcagtagcagaaaacaaaggccctagagtggccattcttacctgaggagacggtgaccgtggtccctttgccccagacgtccatgtagtagtagtagtagtcgacttcggaacagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccttcggaacagctagtgctgagcgggctggcaaggc

SEQ ID NO: 2434 - DNA, 495 bp, Artificial Sequence
  Oligonucleotide
gcctccctcgcgccatcagttcggaactaaccaagggcagtagcagaaaacaaaggccctagagtggccattcttacctgaggagacggtgaccgtggtccctttgccccagacgtccatgtagtagtagtagtagtcgacttcggaactaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccttcggaactaaccaagctgagcgggctggcaaggc

SEQ ID NO: 2435 - DNA, 495 bp, Artificial Sequence
  Oligonucleotide
gcctccctcgcgccatcagttcggaaccaagaggtggcagtagcagaaaacaaaggccctagagtggccattcttacctgaggagacggtgaccgtggtccctttgccccagacgtccatgtagtagtagtagtagtcgacttcggaaccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccttcggaaccaagaggtctgagcgggctggcaaggc

SEQ ID NO: 2436 - DNA, 495 bp, Artificial Sequence
  Oligonucleotide
gcctccctcgcgccatcagttcggaacagttgaccggcagtagcagaaaacaaaggccctagagtggccattcttacctgaggagacggtgaccgtggtccctttgccccagacgtccatgtagtagtagtagtagtcgacttcggaacagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaattcggaacagttgaccctgagcgggctggcaaggc

SEQ ID NO: 2437 - DNA, 495 bp, Artificial Sequence
  Oligonucleotide
gcctccctcgcgccatcagttcggaaccagcatatggcagtagcagaaaacaaaggccctagagtggccattcttacctgaggagacggtgaccgtggtccctttgccccagacgtccatgtagtagtagtagtagtcgacttcggaaccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaattcggaaccagcatatctgagcgggctggcaaggc

SEQ ID NO: 2438 - DNA, 495 bp, Artificial Sequence
  Oligonucleotide
gcctccctcgcgccatcagttcggaacgcaggattggcagtagcagaaaacaaaggccctagagtggccattcttacctgaggagacggtgaccgtggtccctttgccccagacgtccatgtagtagtagtagtagtcgacttcggaacgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataattcggaacgcaggattctgagcgggctggcaaggc

SEQ ID NO: 2439 - DNA, 495 bp, Artificial Sequence
  Oligonucleotide
gcctccctcgcgccatcagttcggaacgtccattcggcagtagcagaaaacaaaggccctagagtggccattcttacctgaggagacggtgaccgtggtccctttgccccagacgtccatgtagtagtagtagtagtcgacttcggaacgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccttcggaacgtccattcctgagcgggctggcaaggc

SEQ ID NO: 2440 - DNA, 495 bp, Artificial Sequence
  Oligonucleotide
gcctccctcgcgccatcagttcggaacgcataactggcagtagcagaaaacaaaggccctagagtggccattcttacctgaggagacggtgaccgtggtccctttgccccagacgtccatgtagtagtagtagtagtcgacttcggaacgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacttcggaacgcataactctgagcgggctggcaaggc

SEQ ID NO: 2441 - DNA, 495 bp, Artificial Sequence
  Oligonucleotide
gcctccctcgcgccatcagttcggaacatatgctgggcagtagcagaaaacaaaggccctagagtggccattcttacctgaggagacggtgaccgtggtccctttgccccagacgtccatgtagtagtagtagtagtcgacttcggaacatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccttcggaacatatgctgctgagcgggctggcaaggc

SEQ ID NO: 2442 - DNA, 495 bp, Artificial Sequence
  Oligonucleotide
gcctccctcgcgccatcagttcggaacaatcctgcggcagtagcagaaaacaaaggccctagagtggccattcttacctgaggagacggtgaccgtggtccctttgccccagacgtccatgtagtagtagtagtagtcgacttcggaacaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcttcggaacaatcctgcctgagcgggctggcaaggc

SEQ ID NO: 2443 - DNA, 495 bp, Artificial Sequence
  Oligonucleotide
gcctccctcgcgccatcagttcggaactgagacctggcagtagcagaaaacaaaggccctagagtggccattcttacctgaggagacggtgaccgtggtccctttgccccagacgtccatgtagtagtagtagtagtcgacttcggaactgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgttcggaactgagacctctgagcgggctggcaaggc

SEQ ID NO: 2444 - DNA, 495 bp, Artificial Sequence
  Oligonucleotide
gcctccctcgcgccatcagttcggaacgaatggacggcagtagcagaaaacaaaggccctagagtggccattcttacctgaggagacggtgaccgtggtccctttgccccagacgtccatgtagtagtagtagtagtcgacttcggaacgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccttcggaacgaatggacctgagcgggctggcaaggc

SEQ ID NO: 2445 - DNA, 495 bp, Artificial Sequence
  Oligonucleotide
gcctccctcgcgccatcagttcggaaccacatggaggcagtagcagaaaacaaaggccctagagtggccattcttacctgaggagacggtgaccgtggtccctttgccccagacgtccatgtagtagtagtagtagtcgacttcggaaccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccttcggaaccacatggactgagcgggctggcaaggc

SEQ ID NO: 2446 - DNA, 495 bp, Artificial Sequence
  Oligonucleotide
gcctccctcgcgccatcagttcggaacttgaccatggcagtagcagaaaacaaaggccctagagtggccattcttacctgaggagacggtgaccgtggtccctttgccccagacgtccatgtagtagtagtagtagtcgacttcggaacttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccttcggaacttgaccatctgagcgggctggcaaggc

SEQ ID NO: 2447 - DNA, 495 bp, Artificial Sequence
  Oligonucleotide
gcctccctcgcgccatcagttcggaacaagccatcggcagtagcagaaaacaaaggccctagagtggccattcttacctgaggagacggtgaccgtggtccctttgccccagacgtccatgtagtagtagtagtagtcgacttcggaacaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccttcggaacaagccatcctgagcgggctggcaaggc

SEQ ID NO: 2448 - DNA, 495 bp, Artificial Sequence
  Oligonucleotide
gcctccctcgcgccatcagttcggaactccatgtgggcagtagcagaaaacaaaggccctagagtggccattcttacctgaggagacggtgaccgtggtccctttgccccagacgtccatgtagtagtagtagtagtcgacttcggaactccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccttcggaactccatgtgctgagcgggctggcaaggc

SEQ ID NO: 2449 - DNA, 495 bp, Artificial Sequence
  Oligonucleotide
gcctccctcgcgccatcagttcggaaccaagtcacggcagtagcagaaaacaaaggccctagagtggccattcttacctgaggagacggtgaccgtggtccctttgccccagacgtccatgtagtagtagtagtagtcgacttcggaaccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccttcggaaccaagtcacctgagcgggctggcaaggc

SEQ ID NO: 2450 - DNA, 495 bp, Artificial Sequence
  Oligonucleotide
gcctccctcgcgccatcagttcggaacctgcaatcggcagtagcagaaaacaaaggccctagagtggccattcttacctgaggagacggtgaccgtggtccctttgccccagacgtccatgtagtagtagtagtagtcgacttcggaacctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccttcggaacctgcaatcctgagcgggctggcaaggc

SEQ ID NO: 2451 - DNA, 495 bp, Artificial Sequence
  Oligonucleotide
gcctccctcgcgccatcagttcggaacatcgacgaggcagtagcagaaaacaaaggccctagagtggccattcttacctgaggagacggtgaccgtggtccctttgccccagacgtccatgtagtagtagtagtagtcgacttcggaacatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccttcggaacatcgacgactgagcgggctggcaaggc

SEQ ID NO: 2452 - DNA, 495 bp, Artificial Sequence
  Oligonucleotide
gcctccctcgcgccatcagttcggaacacagactgggcagtagcagaaaacaaaggccctagagtggccattcttacctgaggagacggtgaccgtggtccctttgccccagacgtccatgtagtagtagtagtagtcgacttcggaacacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaattcggaacacagactgctgagcgggctggcaaggc

SEQ ID NO: 2453 - DNA, 495 bp, Artificial Sequence
  Oligonucleotide
gcctccctcgcgccatcagttcggaacccttatagggcagtagcagaaaacaaaggccctagagtggccattcttacctgaggagacggtgaccgtggtccctttgccccagacgtccatgtagtagtagtagtagtcgacttcggaacccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacttcggaacccttatagctgagcgggctggcaaggc

SEQ ID NO: 2454 - DNA, 495 bp, Artificial Sequence
  Oligonucleotide
gcctccctcgcgccatcagttcggaactacgcgttggcagtagcagaaaacaaaggccctagagtggccattcttacctgaggagacggtgaccgtggtccctttgccccagacgtccatgtagtagtagtagtagtcgacttcggaactacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccttcggaactacgcgttctgagcgggctggcaaggc

SEQ ID NO: 2455 - DNA, 495 bp, Artificial Sequence
  Oligonucleotide
gcctccctcgcgccatcagttcggaacctataaggggcagtagcagaaaacaaaggccctagagtggccattcttacctgaggagacggtgaccgtggtccctttgccccagacgtccatgtagtagtagtagtagtcgacttcggaacctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgttcggaacctataaggctgagcgggctggcaaggc

SEQ ID NO: 2456 - DNA, 495 bp, Artificial Sequence
  Oligonucleotide
gcctccctcgcgccatcagttcggaactcttagtcggcagtagcagaaaacaaaggccctagagtggccattcttacctgaggagacggtgaccgtggtccctttgccccagacgtccatgtagtagtagtagtagtcgacttcggaactcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcttcggaactcttagtcctgagcgggctggcaaggc

SEQ ID NO: 2457 - DNA, 495 bp, Artificial Sequence
  Oligonucleotide
gcctccctcgcgccatcagttcggaactgtctgcaggcagtagcagaaaacaaaggccctagagtggccattcttacctgaggagacggtgaccgtggtccctttgccccagacgtccatgtagtagtagtagtagtcgacttcggaactgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccttcggaactgtctgcactgagcgggctggcaaggc

SEQ ID NO: 2458 - DNA, 495 bp, Artificial Sequence
  Oligonucleotide
gcctccctcgcgccatcagttcggaacgccattaaggcagtagcagaaaacaaaggccctagagtggccattcttacctgaggagacggtgaccgtggtccctttgccccagacgtccatgtagtagtagtagtagtcgacttcggaacgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcttcggaacgccattaactgagcgggctggcaaggc

SEQ ID NO: 2459 - DNA, 495 bp, Artificial Sequence
  Oligonucleotide
gcctccctcgcgccatcagttcggaacgactaagaggcagtagcagaaaacaaaggccctagagtggccattcttacctgaggagacggtgaccgtggtccctttgccccagacgtccatgtagtagtagtagtagtcgacttcggaacgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgttcggaacgactaagactgagcgggctggcaaggc

SEQ ID NO: 2460 - DNA, 495 bp, Artificial Sequence
  Oligonucleotide
gcctccctcgcgccatcagttcggaacaggttgctggcagtagcagaaaacaaaggccctagagtggccattcttacctgaggagacggtgaccgtggtccctttgccccagacgtccatgtagtagtagtagtagtcgacttcggaacaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgttcggaacaggttgctctgagcgggctggcaaggc

SEQ ID NO: 2461 - DNA, 495 bp, Artificial Sequence
  Oligonucleotide
gcctccctcgcgccatcagttcggaacctcgagaaggcagtagcagaaaacaaaggccctagagtggccattcttacctgaggagacggtgaccgtggtccctttgccccagacgtccatgtagtagtagtagtagtcgacttcggaacctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccttcggaacctcgagaactgagcgggctggcaaggc

SEQ ID NO: 2462 - DNA, 495 bp, Artificial Sequence
  Oligonucleotide
gcctccctcgcgccatcagttcggaacttaatggcggcagtagcagaaaacaaaggccctagagtggccattcttacctgaggagacggtgaccgtggtccctttgccccagacgtccatgtagtagtagtagtagtcgacttcggaacttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccttcggaacttaatggcctgagcgggctggcaaggc

SEQ ID NO: 2463 - DNA, 495 bp, Artificial Sequence
  Oligonucleotide
gcctccctcgcgccatcagttcggaactgcagacaggcagtagcagaaaacaaaggccctagagtggccattcttacctgaggagacggtgaccgtggtccctttgccccagacgtccatgtagtagtagtagtagtcgacttcggaactgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaattcggaactgcagacactgagcgggctggcaaggc

SEQ ID NO: 2464 - DNA, 495 bp, Artificial Sequence
  Oligonucleotide
gcctccctcgcgccatcagttcggaactcactgagggcagtagcagaaaacaaaggccctagagtggccattcttacctgaggagacggtgaccgtggtccctttgccccagacgtccatgtagtagtagtagtagtcgacttcggaactcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtttcggaactcactgagctgagcgggctggcaaggc

SEQ ID NO: 2465 - DNA, 495 bp, Artificial Sequence
  Oligonucleotide
gcctccctcgcgccatcagttcggaacgagtacgtggcagtagcagaaaacaaaggccctagagtggccattcttacctgaggagacggtgaccgtggtccctttgccccagacgtccatgtagtagtagtagtagtcgacttcggaacgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacttcggaacgagtacgtctgagcgggctggcaaggc

SEQ ID NO: 2466 - DNA, 495 bp, Artificial Sequence
  Oligonucleotide
gcctccctcgcgccatcagttcggaacatacgccaggcagtagcagaaaacaaaggccctagagtggccattcttacctgaggagacggtgaccgtggtccctttgccccagacgtccatgtagtagtagtagtagtcgacttcggaacatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacttcggaacatacgccactgagcgggctggcaaggc

SEQ ID NO: 2467 - DNA, 495 bp, Artificial Sequence
  Oligonucleotide
gcctccctcgcgccatcagttcggaactcgcatcaggcagtagcagaaaacaaaggccctagagtggccattcttacctgaggagacggtgaccgtggtccctttgccccagacgtccatgtagtagtagtagtagtcgacttcggaactcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacttcggaactcgcatcactgagcgggctggcaaggc

SEQ ID NO: 2468 - DNA, 495 bp, Artificial Sequence
  Oligonucleotide
gcctccctcgcgccatcagttcggaaccgcttaatggcagtagcagaaaacaaaggccctagagtggccattcttacctgaggagacggtgaccgtggtccctttgccccagacgtccatgtagtagtagtagtagtcgacttcggaaccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacttcggaaccgcttaatctgagcgggctggcaaggc

SEQ ID NO: 2469 - DNA, 495 bp, Artificial Sequence
  Oligonucleotide
gcctccctcgcgccatcagttcggaactggttatcggcagtagcagaaaacaaaggccctagagtggccattcttacctgaggagacggtgaccgtggtccctttgccccagacgtccatgtagtagtagtagtagtcgacttcggaactggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtttcggaactggttatcctgagcgggctggcaaggc

SEQ ID NO: 2470 - DNA, 495 bp, Artificial Sequence
  Oligonucleotide
gcctccctcgcgccatcagttcggaacggattgctggcagtagcagaaaacaaaggccctagagtggccattcttacctgaggagacggtgaccgtggtccctttgccccagacgtccatgtagtagtagtagtagtcgacttcggaacggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacttcggaacggattgctctgagcgggctggcaaggc

SEQ ID NO: 2471 - DNA, 495 bp, Artificial Sequence
  Oligonucleotide
gcctccctcgcgccatcagttcggaacctcagtgaggcagtagcagaaaacaaaggccctagagtggccattcttacctgaggagacggtgaccgtggtccctttgccccagacgtccatgtagtagtagtagtagtcgacttcggaacctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtttcggaacctcagtgactgagcgggctggcaaggc

SEQ ID NO: 2472 - DNA, 495 bp, Artificial Sequence
  Oligonucleotide
gcctccctcgcgccatcagttcggaacacgtactcggcagtagcagaaaacaaaggccctagagtggccattcttacctgaggagacggtgaccgtggtccctttgccccagacgtccatgtagtagtagtagtagtcgacttcggaacacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacttcggaacacgtactcctgagcgggctggcaaggc

SEQ ID NO: 2473 - DNA, 495 bp, Artificial Sequence
  Oligonucleotide
gcctccctcgcgccatcagttcggaactgatgcgaggcagtagcagaaaacaaaggccctagagtggccattcttacctgaggagacggtgaccgtggtccctttgccccagacgtccatgtagtagtagtagtagtcgacttcggaactgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccttcggaactgatgcgactgagcgggctggcaaggc

SEQ ID NO: 2474 - DNA, 495 bp, Artificial Sequence
  Oligonucleotide
gcctccctcgcgccatcagttcggaacattaagcgggcagtagcagaaaacaaaggccctagagtggccattcttacctgaggagacggtgaccgtggtccctttgccccagacgtccatgtagtagtagtagtagtcgacttcggaacattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccttcggaacattaagcgctgagcgggctggcaaggc

SEQ ID NO: 2475 - DNA, 495 bp, Artificial Sequence
  Oligonucleotide
gcctccctcgcgccatcagttcggaacagcaatccggcagtagcagaaaacaaaggccctagagtggccattcttacctgaggagacggtgaccgtggtccctttgccccagacgtccatgtagtagtagtagtagtcgacttcggaacagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccttcggaacagcaatccctgagcgggctggcaaggc

SEQ ID NO: 2476 - DNA, 495 bp, Artificial Sequence
  Oligonucleotide
gcctccctcgcgccatcagttcggaacgcttagtaggcagtagcagaaaacaaaggccctagagtggccattcttacctgaggagacggtgaccgtggtccctttgccccagacgtccatgtagtagtagtagtagtcgacttcggaacgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgattcggaacgcttagtactgagcgggctggcaaggc

SEQ ID NO: 2477 - DNA, 495 bp, Artificial Sequence
  Oligonucleotide
gcctccctcgcgccatcagttcggaactgaccttgggcagtagcagaaaacaaaggccctagagtggccattcttacctgaggagacggtgaccgtggtccctttgccccagacgtccatgtagtagtagtagtagtcgacttcggaactgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccttcggaactgaccttgctgagcgggctggcaaggc

SEQ ID NO: 2478 - DNA, 495 bp, Artificial Sequence
  Oligonucleotide
gcctccctcgcgccatcagttcggaaccaaggtcaggcagtagcagaaaacaaaggccctagagtggccattcttacctgaggagacggtgaccgtggtccctttgccccagacgtccatgtagtagtagtagtagtcgacttcggaaccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccttcggaaccaaggtcactgagcgggctggcaaggc

SEQ ID NO: 2479 - DNA, 495 bp, Artificial Sequence
  Oligonucleotide
gcctccctcgcgccatcagttcggaaccactgtacggcagtagcagaaaacaaaggccctagagtggccattcttacctgaggagacggtgaccgtggtccctttgccccagacgtccatgtagtagtagtagtagtcgacttcggaaccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcttcggaaccactgtacctgagcgggctggcaaggc

SEQ ID NO: 2480 - DNA, 495 bp, Artificial Sequence
  Oligonucleotide
gcctccctcgcgccatcagttcggaacgatgatccggcagtagcagaaaacaaaggccctagagtggccattcttacctgaggagacggtgaccgtggtccctttgccccagacgtccatgtagtagtagtagtagtcgacttcggaacgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggttcggaacgatgatccctgagcgggctggcaaggc

SEQ ID NO: 2481 - DNA, 495 bp, Artificial Sequence
  Oligonucleotide
gcctccctcgcgccatcagttcggaaccgccaataggcagtagcagaaaacaaaggccctagagtggccattcttacctgaggagacggtgaccgtggtccctttgccccagacgtccatgtagtagtagtagtagtcgacttcggaaccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggttcggaaccgccaatactgagcgggctggcaaggc

SEQ ID NO: 2482 - DNA, 495 bp, Artificial Sequence
  Oligonucleotide
gcctccctcgcgccatcagttcggaactcaagcctggcagtagcagaaaacaaaggccctagagtggccattcttacctgaggagacggtgaccgtggtccctttgccccagacgtccatgtagtagtagtagtagtcgacttcggaactcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacattcggaactcaagcctctgagcgggctggcaaggc

SEQ ID NO: 2483 - DNA, 495 bp, Artificial Sequence
  Oligonucleotide
gcctccctcgcgccatcagttcggaacacgtgtgtggcagtagcagaaaacaaaggccctagagtggccattcttacctgaggagacggtgaccgtggtccctttgccccagacgtccatgtagtagtagtagtagtcgacttcggaacacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagttcggaacacgtgtgtctgagcgggctggcaaggc

SEQ ID NO: 2484 - DNA, 495 bp, Artificial Sequence
  Oligonucleotide
gcctccctcgcgccatcagttcggaactccgtctaggcagtagcagaaaacaaaggccctagagtggccattcttacctgaggagacggtgaccgtggtccctttgccccagacgtccatgtagtagtagtagtagtcgacttcggaactccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagttcggaactccgtctactgagcgggctggcaaggc

SEQ ID NO: 2485 - DNA, 495 bp, Artificial Sequence
  Oligonucleotide
gcctccctcgcgccatcagttcggaacaagagctgggcagtagcagaaaacaaaggccctagagtggccattcttacctgaggagacggtgaccgtggtccctttgccccagacgtccatgtagtagtagtagtagtcgacttcggaacaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgttcggaacaagagctgctgagcgggctggcaaggc

SEQ ID NO: 2486 - DNA, 495 bp, Artificial Sequence
  Oligonucleotide
gcctccctcgcgccatcagttcggaactatcgctcggcagtagcagaaaacaaaggccctagagtggccattcttacctgaggagacggtgaccgtggtccctttgccccagacgtccatgtagtagtagtagtagtcgacttcggaactatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagttcggaactatcgctcctgagcgggctggcaaggc

SEQ ID NO: 2487 - DNA, 495 bp, Artificial Sequence
  Oligonucleotide
gcctccctcgcgccatcagttcggaactcagatgcggcagtagcagaaaacaaaggccctagagtggccattcttacctgaggagacggtgaccgtggtccctttgccccagacgtccatgtagtagtagtagtagtcgacttcggaactcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccttcggaactcagatgcctgagcgggctggcaaggc

SEQ ID NO: 2488 - DNA, 495 bp, Artificial Sequence
  Oligonucleotide
gcctccctcgcgccatcagttcggaacgtgtagcaggcagtagcagaaaacaaaggccctagagtggccattcttacctgaggagacggtgaccgtggtccctttgccccagacgtccatgtagtagtagtagtagtcgacttcggaacgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgttcggaacgtgtagcactgagcgggctggcaaggc

SEQ ID NO: 2489 - DNA, 495 bp, Artificial Sequence
  Oligonucleotide
gcctccctcgcgccatcagttcggaactggcagttggcagtagcagaaaacaaaggccctagagtggccattcttacctgaggagacggtgaccgtggtccctttgccccagacgtccatgtagtagtagtagtagtcgacttcggaactggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgttcggaactggcagttctgagcgggctggcaaggc

SEQ ID NO: 2490 - DNA, 495 bp, Artificial Sequence
  Oligonucleotide
gcctccctcgcgccatcagttcggaaccagtccaaggcagtagcagaaaacaaaggccctagagtggccattcttacctgaggagacggtgaccgtggtccctttgccccagacgtccatgtagtagtagtagtagtcgacttcggaaccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacttcggaaccagtccaactgagcgggctggcaaggc

SEQ ID NO: 2491 - DNA, 495 bp, Artificial Sequence
  Oligonucleotide
gcctccctcgcgccatcagttcggaacgtgtctacggcagtagcagaaaacaaaggccctagagtggccattcttacctgaggagacggtgaccgtggtccctttgccccagacgtccatgtagtagtagtagtagtcgacttcggaacgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggttcggaacgtgtctacctgagcgggctggcaaggc

SEQ ID NO: 2492 - DNA, 495 bp, Artificial Sequence
  Oligonucleotide
gcctccctcgcgccatcagttcggaacgtacagtgggcagtagcagaaaacaaaggccctagagtggccattcttacctgaggagacggtgaccgtggtccctttgccccagacgtccatgtagtagtagtagtagtcgacttcggaacgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagttcggaacgtacagtgctgagcgggctggcaaggc

SEQ ID NO: 2493 - DNA, 495 bp, Artificial Sequence
  Oligonucleotide
gcctccctcgcgccatcagttcggaacggatcatcggcagtagcagaaaacaaaggccctagagtggccattcttacctgaggagacggtgaccgtggtccctttgccccagacgtccatgtagtagtagtagtagtcgacttcggaacggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagttcggaacggatcatcctgagcgggctggcaaggc

SEQ ID NO: 2494 - DNA, 495 bp, Artificial Sequence
  Oligonucleotide
gcctccctcgcgccatcagttcggaactattggcgggcagtagcagaaaacaaaggccctagagtggccattcttacctgaggagacggtgaccgtggtccctttgccccagacgtccatgtagtagtagtagtagtcgacttcggaactattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcattcggaactattggcgctgagcgggctggcaaggc

SEQ ID NO: 2495 - DNA, 495 bp, Artificial Sequence
  Oligonucleotide
gcctccctcgcgccatcagttcggaacaggcttgaggcagtagcagaaaacaaaggccctagagtggccattcttacctgaggagacggtgaccgtggtccctttgccccagacgtccatgtagtagtagtagtagtcgacttcggaacaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacttcggaacaggcttgactgagcgggctggcaaggc

SEQ ID NO: 2496 - DNA, 495 bp, Artificial Sequence
  Oligonucleotide
gcctccctcgcgccatcagttcggaacacacacgtggcagtagcagaaaacaaaggccctagagtggccattcttacctgaggagacggtgaccgtggtccctttgccccagacgtccatgtagtagtagtagtagtcgacttcggaacacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatttcggaacacacacgtctgagcgggctggcaaggc

SEQ ID NO: 2497 - DNA, 495 bp, Artificial Sequence
  Oligonucleotide
gcctccctcgcgccatcagttcggaactagacggaggcagtagcagaaaacaaaggccctagagtggccattcttacctgaggagacggtgaccgtggtccctttgccccagacgtccatgtagtagtagtagtagtcgacttcggaactagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgattcggaactagacggactgagcgggctggcaaggc

SEQ ID NO: 2498 - DNA, 495 bp, Artificial Sequence
  Oligonucleotide
gcctccctcgcgccatcagttcggaacgagcgataggcagtagcagaaaacaaaggccctagagtggccattcttacctgaggagacggtgaccgtggtccctttgccccagacgtccatgtagtagtagtagtagtcgacttcggaacgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttttcggaacgagcgatactgagcgggctggcaaggc

SEQ ID NO: 2499 - DNA, 495 bp, Artificial Sequence
  Oligonucleotide
gcctccctcgcgccatcagttcggaacgcatctgaggcagtagcagaaaacaaaggccctagagtggccattcttacctgaggagacggtgaccgtggtccctttgccccagacgtccatgtagtagtagtagtagtcgacttcggaacgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacattcggaacgcatctgactgagcgggctggcaaggc

SEQ ID NO: 2500 - DNA, 495 bp, Artificial Sequence
  Oligonucleotide
gcctccctcgcgccatcagttcggaactgctacacggcagtagcagaaaacaaaggccctagagtggccattcttacctgaggagacggtgaccgtggtccctttgccccagacgtccatgtagtagtagtagtagtcgacttcggaactgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgttcggaactgctacacctgagcgggctggcaaggc

SEQ ID NO: 2501 - DNA, 495 bp, Artificial Sequence
  Oligonucleotide
gcctccctcgcgccatcagttcggaacaactgccaggcagtagcagaaaacaaaggccctagagtggccattcttacctgaggagacggtgaccgtggtccctttgccccagacgtccatgtagtagtagtagtagtcgacttcggaacaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttttcggaacaactgccactgagcgggctggcaaggc

SEQ ID NO: 2502 - DNA, 495 bp, Artificial Sequence
  Oligonucleotide
gcctccctcgcgccatcagttcggaacttggactgggcagtagcagaaaacaaaggccctagagtggccattcttacctgaggagacggtgaccgtggtccctttgccccagacgtccatgtagtagtagtagtagtcgacttcggaacttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggttcggaacttggactgctgagcgggctggcaaggc

SEQ ID NO: 2503 - DNA, 495 bp, Artificial Sequence
  Oligonucleotide
gcctccctcgcgccatcagttcggaactcggtactggcagtagcagaaaacaaaggccctagagtggccattcttacctgaggagacggtgaccgtggtccctttgccccagacgtccatgtagtagtagtagtagtcgacttcggaactcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgttcggaactcggtactctgagcgggctggcaaggc

SEQ ID NO: 2504 - DNA, 495 bp, Artificial Sequence
  Oligonucleotide
gcctccctcgcgccatcagttcggaacccatggatggcagtagcagaaaacaaaggccctagagtggccattcttacctgaggagacggtgaccgtggtccctttgccccagacgtccatgtagtagtagtagtagtcgacttcggaacccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacttcggaacccatggatctgagcgggctggcaaggc

SEQ ID NO: 2505 - DNA, 495 bp, Artificial Sequence
  Oligonucleotide
gcctccctcgcgccatcagttcggaacacgaagatggcagtagcagaaaacaaaggccctagagtggccattcttacctgaggagacggtgaccgtggtccctttgccccagacgtccatgtagtagtagtagtagtcgacttcggaacacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaattcggaacacgaagatctgagcgggctggcaaggc

SEQ ID NO: 2506 - DNA, 495 bp, Artificial Sequence
  Oligonucleotide
gcctccctcgcgccatcagttcggaacactgtggaggcagtagcagaaaacaaaggccctagagtggccattcttacctgaggagacggtgaccgtggtccctttgccccagacgtccatgtagtagtagtagtagtcgacttcggaacactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttttcggaacactgtggactgagcgggctggcaaggc

SEQ ID NO: 2507 - DNA, 495 bp, Artificial Sequence
  Oligonucleotide
gcctccctcgcgccatcagttcggaacggtgtcatggcagtagcagaaaacaaaggccctagagtggccattcttacctgaggagacggtgaccgtggtccctttgccccagacgtccatgtagtagtagtagtagtcgacttcggaacggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctttcggaacggtgtcatctgagcgggctggcaaggc

SEQ ID NO: 2508 - DNA, 495 bp, Artificial Sequence
  Oligonucleotide
gcctccctcgcgccatcagttcggaactcgtgaagggcagtagcagaaaacaaaggccctagagtggccattcttacctgaggagacggtgaccgtggtccctttgccccagacgtccatgtagtagtagtagtagtcgacttcggaactcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggttcggaactcgtgaagctgagcgggctggcaaggc

SEQ ID NO: 2509 - DNA, 495 bp, Artificial Sequence
  Oligonucleotide
gcctccctcgcgccatcagttcggaaccactagctggcagtagcagaaaacaaaggccctagagtggccattcttacctgaggagacggtgaccgtggtccctttgccccagacgtccatgtagtagtagtagtagtcgacttcggaaccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaattcggaaccactagctctgagcgggctggcaaggc

SEQ ID NO: 2510 - DNA, 495 bp, Artificial Sequence
  Oligonucleotide
gcctccctcgcgccatcagttcggaacggtcaactggcagtagcagaaaacaaaggccctagagtggccattcttacctgaggagacggtgaccgtggtccctttgccccagacgtccatgtagtagtagtagtagtcgacttcggaacggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggattcggaacggtcaactctgagcgggctggcaaggc

SEQ ID NO: 2511 - DNA, 495 bp, Artificial Sequence
  Oligonucleotide
gcctccctcgcgccatcagttcggaactacgtacgggcagtagcagaaaacaaaggccctagagtggccattcttacctgaggagacggtgaccgtggtccctttgccccagacgtccatgtagtagtagtagtagtcgacttcggaactacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcttcggaactacgtacgctgagcgggctggcaaggc

SEQ ID NO: 2512 - DNA, 495 bp, Artificial Sequence
  Oligonucleotide
gcctccctcgcgccatcagttcggaacatgacaccggcagtagcagaaaacaaaggccctagagtggccattcttacctgaggagacggtgaccgtggtccctttgccccagacgtccatgtagtagtagtagtagtcgacttcggaacatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggttcggaacatgacaccctgagcgggctggcaaggc

SEQ ID NO: 2513 - DNA, 495 bp, Artificial Sequence
  Oligonucleotide
gcctccctcgcgccatcagttcggaaccttcacgaggcagtagcagaaaacaaaggccctagagtggccattcttacctgaggagacggtgaccgtggtccctttgccccagacgtccatgtagtagtagtagtagtcgacttcggaaccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacttcggaaccttcacgactgagcgggctggcaaggc

SEQ ID NO: 2514 - DNA, 495 bp, Artificial Sequence
  Oligonucleotide
gcctccctcgcgccatcagttcggaacagaatcagggcagtagcagaaaacaaaggccctagagtggccattcttacctgaggagacggtgaccgtggtccctttgccccagacgtccatgtagtagtagtagtagtcgacttcggaacagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccttcggaacagaatcagctgagcgggctggcaaggc

SEQ ID NO: 2515 - DNA, 495 bp, Artificial Sequence
  Oligonucleotide
gcctccctcgcgccatcagttcggaacagttatgcggcagtagcagaaaacaaaggccctagagtggccattcttacctgaggagacggtgaccgtggtccctttgccccagacgtccatgtagtagtagtagtagtcgacttcggaacagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataattcggaacagttatgcctgagcgggctggcaaggc

SEQ ID NO: 2516 - DNA, 495 bp, Artificial Sequence
  Oligonucleotide
gcctccctcgcgccatcagttcggaacaggtctcaggcagtagcagaaaacaaaggccctagagtggccattcttacctgaggagacggtgaccgtggtccctttgccccagacgtccatgtagtagtagtagtagtcgacttcggaacaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccttcggaacaggtctcactgagcgggctggcaaggc

SEQ ID NO: 2517 - DNA, 495 bp, Artificial Sequence
  Oligonucleotide
gcctccctcgcgccatcagttcggaacgtcatagtggcagtagcagaaaacaaaggccctagagtggccattcttacctgaggagacggtgaccgtggtccctttgccccagacgtccatgtagtagtagtagtagtcgacttcggaacgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtttcggaacgtcatagtctgagcgggctggcaaggc

SEQ ID NO: 2518 - DNA, 495 bp, Artificial Sequence
  Oligonucleotide
gcctccctcgcgccatcagttcggaacgtgacttgggcagtagcagaaaacaaaggccctagagtggccattcttacctgaggagacggtgaccgtggtccctttgccccagacgtccatgtagtagtagtagtagtcgacttcggaacgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgttcggaacgtgacttgctgagcgggctggcaaggc

SEQ ID NO: 2519 - DNA, 495 bp, Artificial Sequence
  Oligonucleotide
gcctccctcgcgccatcagttcggaacgattgcagggcagtagcagaaaacaaaggccctagagtggccattcttacctgaggagacggtgaccgtggtccctttgccccagacgtccatgtagtagtagtagtagtcgacttcggaacgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccttcggaacgattgcagctgagcgggctggcaaggc

SEQ ID NO: 2520 - DNA, 495 bp, Artificial Sequence
  Oligonucleotide
gcctccctcgcgccatcagttcggaacactatgacggcagtagcagaaaacaaaggccctagagtggccattcttacctgaggagacggtgaccgtggtccctttgccccagacgtccatgtagtagtagtagtagtcgacttcggaacactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacttcggaacactatgacctgagcgggctggcaaggc

SEQ ID NO: 2521 - DNA, 495 bp, Artificial Sequence
  Oligonucleotide
gcctccctcgcgccatcagttcggaacatggtcaaggcagtagcagaaaacaaaggccctagagtggccattcttacctgaggagacggtgaccgtggtccctttgccccagacgtccatgtagtagtagtagtagtcgacttcggaacatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacttcggaacatggtcaactgagcgggctggcaaggc

SEQ ID NO: 2522 - DNA, 495 bp, Artificial Sequence
  Oligonucleotide
gcctccctcgcgccatcagttcggaacgatggcttggcagtagcagaaaacaaaggccctagagtggccattcttacctgaggagacggtgaccgtggtccctttgccccagacgtccatgtagtagtagtagtagtcgacttcggaacgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacttcggaacgatggcttctgagcgggctggcaaggc

SEQ ID NO: 2523 - DNA, 495 bp, Artificial Sequence
  Oligonucleotide
gcctccctcgcgccatcagttcggaacagcatatgggcagtagcagaaaacaaaggccctagagtggccattcttacctgaggagacggtgaccgtggtccctttgccccagacgtccatgtagtagtagtagtagtcgacttcggaacagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacttcggaacagcatatgctgagcgggctggcaaggc

SEQ ID NO: 2524 - DNA, 495 bp, Artificial Sequence
  Oligonucleotide
gcctccctcgcgccatcagttcggaaccatatgctggcagtagcagaaaacaaaggccctagagtggccattcttacctgaggagacggtgaccgtggtccctttgccccagacgtccatgtagtagtagtagtagtcgacttcggaaccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgttcggaaccatatgctctgagcgggctggcaaggc

SEQ ID NO: 2525 - DNA, 495 bp, Artificial Sequence
  Oligonucleotide
gcctccctcgcgccatcagttcggaactcgtcgatggcagtagcagaaaacaaaggccctagagtggccattcttacctgaggagacggtgaccgtggtccctttgccccagacgtccatgtagtagtagtagtagtcgacttcggaactcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccttcggaactcgtcgatctgagcgggctggcaaggc

SEQ ID NO: 2526 - DNA, 495 bp, Artificial Sequence
  Oligonucleotide
gcctccctcgcgccatcagttcggaaccagtctgtggcagtagcagaaaacaaaggccctagagtggccattcttacctgaggagacggtgaccgtggtccctttgccccagacgtccatgtagtagtagtagtagtcgacttcggaaccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcttcggaaccagtctgtctgagcgggctggcaaggc

SEQ ID NO: 2527 - DNA, 495 bp, Artificial Sequence
  Oligonucleotide
gcctccctcgcgccatcagttcggaacaacgcgtaggcagtagcagaaaacaaaggccctagagtggccattcttacctgaggagacggtgaccgtggtccctttgccccagacgtccatgtagtagtagtagtagtcgacttcggaacaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgttcggaacaacgcgtactgagcgggctggcaaggc

SEQ ID NO: 2528 - DNA, 495 bp, Artificial Sequence
  Oligonucleotide
gcctccctcgcgccatcagttcggaacgtagttcgggcagtagcagaaaacaaaggccctagagtggccattcttacctgaggagacggtgaccgtggtccctttgccccagacgtccatgtagtagtagtagtagtcgacttcggaacgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcttcggaacgtagttcgctgagcgggctggcaaggc

SEQ ID NO: 2529 - DNA, 495 bp, Artificial Sequence
  Oligonucleotide
gcctccctcgcgccatcagttcggaaccgaactacggcagtagcagaaaacaaaggccctagagtggccattcttacctgaggagacggtgaccgtggtccctttgccccagacgtccatgtagtagtagtagtagtcgacttcggaaccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacttcggaaccgaactacctgagcgggctggcaaggc

SEQ ID NO: 2530 - DNA, 495 bp, Artificial Sequence
  Oligonucleotide
gcctccctcgcgccatcagttcggaacttaacgtcggcagtagcagaaaacaaaggccctagagtggccattcttacctgaggagacggtgaccgtggtccctttgccccagacgtccatgtagtagtagtagtagtcgacttcggaacttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccttcggaacttaacgtcctgagcgggctggcaaggc

SEQ ID NO: 2531 - DNA, 495 bp, Artificial Sequence
  Oligonucleotide
gcctccctcgcgccatcagttcggaacagcaacctggcagtagcagaaaacaaaggccctagagtggccattcttacctgaggagacggtgaccgtggtccctttgccccagacgtccatgtagtagtagtagtagtcgacttcggaacagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacttcggaacagcaacctctgagcgggctggcaaggc

SEQ ID NO: 2532 - DNA, 495 bp, Artificial Sequence
  Oligonucleotide
gcctccctcgcgccatcagttcggaacttctcgagggcagtagcagaaaacaaaggccctagagtggccattcttacctgaggagacggtgaccgtggtccctttgccccagacgtccatgtagtagtagtagtagtcgacttcggaacttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttttcggaacttctcgagctgagcgggctggcaaggc

SEQ ID NO: 2533 - DNA, 495 bp, Artificial Sequence
  Oligonucleotide
gcctccctcgcgccatcagttcggaacactctacgggcagtagcagaaaacaaaggccctagagtggccattcttacctgaggagacggtgaccgtggtccctttgccccagacgtccatgtagtagtagtagtagtcgacttcggaacactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacttcggaacactctacgctgagcgggctggcaaggc

SEQ ID NO: 2534 - DNA, 495 bp, Artificial Sequence
  Oligonucleotide
gcctccctcgcgccatcagttcggaactaccggaaggcagtagcagaaaacaaaggccctagagtggccattcttacctgaggagacggtgaccgtggtccctttgccccagacgtccatgtagtagtagtagtagtcgacttcggaactaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccttcggaactaccggaactgagcgggctggcaaggc

SEQ ID NO: 2535 - DNA, 495 bp, Artificial Sequence
  Oligonucleotide
gcctccctcgcgccatcagttcggaaccgaattgcggcagtagcagaaaacaaaggccctagagtggccattcttacctgaggagacggtgaccgtggtccctttgccccagacgtccatgtagtagtagtagtagtcgacttcggaaccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacttcggaaccgaattgcctgagcgggctggcaaggc

SEQ ID NO: 2536 - DNA, 495 bp, Artificial Sequence
  Oligonucleotide
gcctccctcgcgccatcagttcggaacttcgctcaggcagtagcagaaaacaaaggccctagagtggccattcttacctgaggagacggtgaccgtggtccctttgccccagacgtccatgtagtagtagtagtagtcgacttcggaacttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacattcggaacttcgctcactgagcgggctggcaaggc

SEQ ID NO: 2537 - DNA, 495 bp, Artificial Sequence
  Oligonucleotide
gcctccctcgcgccatcagttcggaacgacgttaaggcagtagcagaaaacaaaggccctagagtggccattcttacctgaggagacggtgaccgtggtccctttgccccagacgtccatgtagtagtagtagtagtcgacttcggaacgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgttcggaacgacgttaactgagcgggctggcaaggc

SEQ ID NO: 2538 - DNA, 495 bp, Artificial Sequence
  Oligonucleotide
gcctccctcgcgccatcagttcggaaccgtagagtggcagtagcagaaaacaaaggccctagagtggccattcttacctgaggagacggtgaccgtggtccctttgccccagacgtccatgtagtagtagtagtagtcgacttcggaaccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcttcggaaccgtagagtctgagcgggctggcaaggc

SEQ ID NO: 2539 - DNA, 495 bp, Artificial Sequence
  Oligonucleotide
gcctccctcgcgccatcagttcggaacttccggtaggcagtagcagaaaacaaaggccctagagtggccattcttacctgaggagacggtgaccgtggtccctttgccccagacgtccatgtagtagtagtagtagtcgacttcggaacttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcttcggaacttccggtactgagcgggctggcaaggc

SEQ ID NO: 2540 - DNA, 495 bp, Artificial Sequence
  Oligonucleotide
gcctccctcgcgccatcagttcggaacgcaattcgggcagtagcagaaaacaaaggccctagagtggccattcttacctgaggagacggtgaccgtggtccctttgccccagacgtccatgtagtagtagtagtagtcgacttcggaacgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacttcggaacgcaattcgctgagcgggctggcaaggc

SEQ ID NO: 2541 - DNA, 495 bp, Artificial Sequence
  Oligonucleotide
gcctccctcgcgccatcagttcggaactgagcgaaggcagtagcagaaaacaaaggccctagagtggccattcttacctgaggagacggtgaccgtggtccctttgccccagacgtccatgtagtagtagtagtagtcgacttcggaactgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcttcggaactgagcgaactgagcgggctggcaaggc

SEQ ID NO: 2542 - DNA, 495 bp, Artificial Sequence
  Oligonucleotide
gcctccctcgcgccatcagttcggaactactaagcggcagtagcagaaaacaaaggccctagagtggccattcttacctgaggagacggtgaccgtggtccctttgccccagacgtccatgtagtagtagtagtagtcgacttcggaactactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccttcggaactactaagcctgagcgggctggcaaggc

SEQ ID NO: 2543 - DNA, 495 bp, Artificial Sequence
  Oligonucleotide
gcctccctcgcgccatcagttcggaactggcgtatggcagtagcagaaaacaaaggccctagagtggccattcttacctgaggagacggtgaccgtggtccctttgccccagacgtccatgtagtagtagtagtagtcgacttcggaactggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtttcggaactggcgtatctgagcgggctggcaaggc

SEQ ID NO: 2544 - DNA, 495 bp, Artificial Sequence
  Oligonucleotide
gcctccctcgcgccatcagttcggaacgataaccaggcagtagcagaaaacaaaggccctagagtggccattcttacctgaggagacggtgaccgtggtccctttgccccagacgtccatgtagtagtagtagtagtcgacttcggaacgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgttcggaacgataaccactgagcgggctggcaaggc

SEQ ID NO: 2545 - DNA, 495 bp, Artificial Sequence
  Oligonucleotide
gcctccctcgcgccatcagttcggaacctagtgaaggcagtagcagaaaacaaaggccctagagtggccattcttacctgaggagacggtgaccgtggtccctttgccccagacgtccatgtagtagtagtagtagtcgacttcggaacctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagttcggaacctagtgaactgagcgggctggcaaggc

SEQ ID NO: 2546 - DNA, 495 bp, Artificial Sequence
  Oligonucleotide
gcctccctcgcgccatcagttcggaacacgttcacggcagtagcagaaaacaaaggccctagagtggccattcttacctgaggagacggtgaccgtggtccctttgccccagacgtccatgtagtagtagtagtagtcgacttcggaacacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtttcggaacacgttcacctgagcgggctggcaaggc

SEQ ID NO: 2547 - DNA, 448 bp, Artificial Sequence
  Oligonucleotide
gcctccctcgcgccatcagttcggaacattacgctggcagtagcagaaaacaaaggccctagagtggccattcttacctgaggagacggtgaccgtggtccctttgccccagacgtccatgtagtagtagtagtagtcgacttcggaacattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcattcggaacattacgctctgagcgggctggcaaggc

SEQ ID NO: 2548 - DNA, 495 bp, Artificial Sequence
  Oligonucleotide
gcctccctcgcgccatcagttcggaaccattgagtggcagtagcagaaaacaaaggccctagagtggccattcttacctgaggagacggtgaccgtggtccctttgccccagacgtccatgtagtagtagtagtagtcgacttcggaaccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccttcggaaccattgagtctgagcgggctggcaaggc

SEQ ID NO: 2549 - DNA, 495 bp, Artificial Sequence
  Oligonucleotide
gcctccctcgcgccatcagaagtaacgcttggttatcagctcagccaaaaccctgcggctggtagggggcctgtggggctgggggctgatgtggctgcggtctccagggcgggtcgggtccaggggcccccagcagtcgacaagtaacgcttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccaagtaacgcttggttactgagcgggctggcaaggc

SEQ ID NO: 2550 - DNA, 495 bp, Artificial Sequence
  Oligonucleotide
gcctccctcgcgccatcagaagtaacgacctcttgtcagctcagccaaaaccctgcggctggtagggggcctgtggggctgggggctgatgtggctgcggtctccagggcgggtcgggtccaggggcccccagcagtcgacaagtaacgacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccaagtaacgacctcttgctgagcgggctggcaaggc

SEQ ID NO: 2551 - DNA, 495 bp, Artificial Sequence
  Oligonucleotide
gcctccctcgcgccatcagaagtaacgctgattcttcagctcagccaaaaccctgcggctggtagggggcctgtggggctgggggctgatgtggctgcggtctccagggcgggtcgggtccaggggcccccagcagtcgacaagtaacgctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccaagtaacgctgattctctgagcgggctggcaaggc

SEQ ID NO: 2552 - DNA, 495 bp, Artificial Sequence
  Oligonucleotide
gcctccctcgcgccatcagaagtaacgagtaccgatcagctcagccaaaaccctgcggctggtagggggcctgtggggctgggggctgatgtggctgcggtctccagggcgggtcgggtccaggggcccccagcagtcgacaagtaacgagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccaagtaacgagtaccgactgagcgggctggcaaggc

SEQ ID NO: 2553 - DNA, 495 bp, Artificial Sequence
  Oligonucleotide
gcctccctcgcgccatcagaagtaacgatccatggtcagctcagccaaaaccctgcggctggtagggggcctgtggggctgggggctgatgtggctgcggtctccagggcgggtcgggtccaggggcccccagcagtcgacaagtaacgatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccaagtaacgatccatggctgagcgggctggcaaggc

SEQ ID NO: 2554 - DNA, 495 bp, Artificial Sequence
  Oligonucleotide
gcctccctcgcgccatcagaagtaacggtagcagttcagctcagccaaaaccctgcggctggtagggggcctgtggggctgggggctgatgtggctgcggtctccagggcgggtcgggtccaggggcccccagcagtcgacaagtaacggtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcaagtaacggtagcagtctgagcgggctggcaaggc

SEQ ID NO: 2555 - DNA, 495 bp, Artificial Sequence
  Oligonucleotide
gcctccctcgcgccatcagaagtaacgatcttcgttcagctcagccaaaaccctgcggctggtagggggcctgtggggctgggggctgatgtggctgcggtctccagggcgggtcgggtccaggggcccccagcagtcgacaagtaacgatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccaagtaacgatcttcgtctgagcgggctggcaaggc

SEQ ID NO: 2556 - DNA, 495 bp, Artificial Sequence
  Oligonucleotide
gcctccctcgcgccatcagaagtaacgtccacagttcagctcagccaaaaccctgcggctggtagggggcctgtggggctgggggctgatgtggctgcggtctccagggcgggtcgggtccaggggcccccagcagtcgacaagtaacgtccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccaagtaacgtccacagtctgagcgggctggcaaggc

SEQ ID NO: 2557 - DNA, 495 bp, Artificial Sequence
  Oligonucleotide
gcctccctcgcgccatcagaagtaacgagctagtgtcagctcagccaaaaccctgcggctggtagggggcctgtggggctgggggctgatgtggctgcggtctccagggcgggtcgggtccaggggcccccagcagtcgacaagtaacgagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccaagtaacgagctagtgctgagcgggctggcaaggc

SEQ ID NO: 2558 - DNA, 495 bp, Artificial Sequence
  Oligonucleotide
gcctccctcgcgccatcagaagtaacgtaaccaagtcagctcagccaaaaccctgcggctggtagggggcctgtggggctgggggctgatgtggctgcggtctccagggcgggtcgggtccaggggcccccagcagtcgacaagtaacgtaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccaagtaacgtaaccaagctgagcgggctggcaaggc

SEQ ID NO: 2559 - DNA, 495 bp, Artificial Sequence
  Oligonucleotide
gcctccctcgcgccatcagaagtaacgcaagaggttcagctcagccaaaaccctgcggctggtagggggcctgtggggctgggggctgatgtggctgcggtctccagggcgggtcgggtccaggggcccccagcagtcgacaagtaacgcaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccaagtaacgcaagaggtctgagcgggctggcaaggc

SEQ ID NO: 2560 - DNA, 495 bp, Artificial Sequence
  Oligonucleotide
gcctccctcgcgccatcagaagtaacgagttgacctcagctcagccaaaaccctgcggctggtagggggcctgtggggctgggggctgatgtggctgcggtctccagggcgggtcgggtccaggggcccccagcagtcgacaagtaacgagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaaaagtaacgagttgaccctgagcgggctggcaaggc

SEQ ID NO: 2561 - DNA, 495 bp, Artificial Sequence
  Oligonucleotide
gcctccctcgcgccatcagaagtaacgcagcatattcagctcagccaaaaccctgcggctggtagggggcctgtggggctgggggctgatgtggctgcggtctccagggcgggtcgggtccaggggcccccagcagtcgacaagtaacgcagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaaaagtaacgcagcatatctgagcgggctggcaaggc

SEQ ID NO: 2562 - DNA, 495 bp, Artificial Sequence
  Oligonucleotide
gcctccctcgcgccatcagaagtaacggcaggatttcagctcagccaaaaccctgcggctggtagggggcctgtggggctgggggctgatgtggctgcggtctccagggcgggtcgggtccaggggcccccagcagtcgacaagtaacggcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataaaagtaacggcaggattctgagcgggctggcaaggc

SEQ ID NO: 2563 - DNA, 495 bp, Artificial Sequence
  Oligonucleotide
gcctccctcgcgccatcagaagtaacggtccattctcagctcagccaaaaccctgcggctggtagggggcctgtggggctgggggctgatgtggctgcggtctccagggcgggtcgggtccaggggcccccagcagtcgacaagtaacggtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccaagtaacggtccattcctgagcgggctggcaaggc

SEQ ID NO: 2564 - DNA, 495 bp, Artificial Sequence
  Oligonucleotide
gcctccctcgcgccatcagaagtaacggcataacttcagctcagccaaaaccctgcggctggtagggggcctgtggggctgggggctgatgtggctgcggtctccagggcgggtcgggtccaggggcccccagcagtcgacaagtaacggcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacaagtaacggcataactctgagcgggctggcaaggc

SEQ ID NO: 2565 - DNA, 495 bp, Artificial Sequence
  Oligonucleotide
gcctccctcgcgccatcagaagtaacgatatgctgtcagctcagccaaaaccctgcggctggtagggggcctgtggggctgggggctgatgtggctgcggtctccagggcgggtcgggtccaggggcccccagcagtcgacaagtaacgatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccaagtaacgatatgctgctgagcgggctggcaaggc

SEQ ID NO: 2566 - DNA, 495 bp, Artificial Sequence
  Oligonucleotide
gcctccctcgcgccatcagaagtaacgaatcctgctcagctcagccaaaaccctgcggctggtagggggcctgtggggctgggggctgatgtggctgcggtctccagggcgggtcgggtccaggggcccccagcagtcgacaagtaacgaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcaagtaacgaatcctgcctgagcgggctggcaaggc

SEQ ID NO: 2567 - DNA, 495 bp, Artificial Sequence
  Oligonucleotide
gcctccctcgcgccatcagaagtaacgtgagaccttcagctcagccaaaaccctgcggctggtagggggcctgtggggctgggggctgatgtggctgcggtctccagggcgggtcgggtccaggggcccccagcagtcgacaagtaacgtgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactgaagtaacgtgagacctctgagcgggctggcaaggc

SEQ ID NO: 2568 - DNA, 495 bp, Artificial Sequence
  Oligonucleotide
gcctccctcgcgccatcagaagtaacggaatggactcagctcagccaaaaccctgcggctggtagggggcctgtggggctgggggctgatgtggctgcggtctccagggcgggtcgggtccaggggcccccagcagtcgacaagtaacggaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccaagtaacggaatggacctgagcgggctggcaaggc

SEQ ID NO: 2569 - DNA, 495 bp, Artificial Sequence
  Oligonucleotide
gcctccctcgcgccatcagaagtaacgcacatggatcagctcagccaaaaccctgcggctggtagggggcctgtggggctgggggctgatgtggctgcggtctccagggcgggtcgggtccaggggcccccagcagtcgacaagtaacgcacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccaagtaacgcacatggactgagcgggctggcaaggc

SEQ ID NO: 2570 - DNA, 495 bp, Artificial Sequence
  Oligonucleotide
gcctccctcgcgccatcagaagtaacgttgaccattcagctcagccaaaaccctgcggctggtagggggcctgtggggctgggggctgatgtggctgcggtctccagggcgggtcgggtccaggggcccccagcagtcgacaagtaacgttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccaagtaacgttgaccatctgagcgggctggcaaggc

SEQ ID NO: 2571 - DNA, 495 bp, Artificial Sequence
  Oligonucleotide
gcctccctcgcgccatcagaagtaacgaagccatctcagctcagccaaaaccctgcggctggtagggggcctgtggggctgggggctgatgtggctgcggtctccagggcgggtcgggtccaggggcccccagcagtcgacaagtaacgaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccaagtaacgaagccatcctgagcgggctggcaaggc

SEQ ID NO: 2572 - DNA, 495 bp, Artificial Sequence
  Oligonucleotide
gcctccctcgcgccatcagaagtaacgtccatgtgtcagctcagccaaaaccctgcggctggtagggggcctgtggggctgggggctgatgtggctgcggtctccagggcgggtcgggtccaggggcccccagcagtcgacaagtaacgtccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccaagtaacgtccatgtgctgagcgggctggcaaggc

SEQ ID NO: 2573 - DNA, 495 bp, Artificial Sequence
  Oligonucleotide
gcctccctcgcgccatcagaagtaacgcaagtcactcagctcagccaaaaccctgcggctggtagggggcctgtggggctgggggctgatgtggctgcggtctccagggcgggtcgggtccaggggcccccagcagtcgacaagtaacgcaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccaagtaacgcaagtcacctgagcgggctggcaaggc

SEQ ID NO: 2574 - DNA, 495 bp, Artificial Sequence
  Oligonucleotide
gcctccctcgcgccatcagaagtaacgctgcaatctcagctcagccaaaaccctgcggctggtagggggcctgtggggctgggggctgatgtggctgcggtctccagggcgggtcgggtccaggggcccccagcagtcgacaagtaacgctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccaagtaacgctgcaatcctgagcgggctggcaaggc

SEQ ID NO: 2575 - DNA, 495 bp, Artificial Sequence
  Oligonucleotide
gcctccctcgcgccatcagaagtaacgatcgacgatcagctcagccaaaaccctgcggctggtagggggcctgtggggctgggggctgatgtggctgcggtctccagggcgggtcgggtccaggggcccccagcagtcgacaagtaacgatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccaagtaacgatcgacgactgagcgggctggcaaggc

SEQ ID NO: 2576 - DNA, 495 bp, Artificial Sequence
  Oligonucleotide
gcctccctcgcgccatcagaagtaacgacagactgtcagctcagccaaaaccctgcggctggtagggggcctgtggggctgggggctgatgtggctgcggtctccagggcgggtcgggtccaggggcccccagcagtcgacaagtaacgacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaaaagtaacgacagactgctgagcgggctggcaaggc

SEQ ID NO: 2577 - DNA, 495 bp, Artificial Sequence
  Oligonucleotide
gcctccctcgcgccatcagaagtaacgccttatagtcagctcagccaaaaccctgcggctggtagggggcctgtggggctgggggctgatgtggctgcggtctccagggcgggtcgggtccaggggcccccagcagtcgacaagtaacgccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacaagtaacgccttatagctgagcgggctggcaaggc

SEQ ID NO: 2578 - DNA, 495 bp, Artificial Sequence
  Oligonucleotide
gcctccctcgcgccatcagaagtaacgtacgcgtttcagctcagccaaaaccctgcggctggtagggggcctgtggggctgggggctgatgtggctgcggtctccagggcgggtcgggtccaggggcccccagcagtcgacaagtaacgtacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccaagtaacgtacgcgttctgagcgggctggcaaggc

SEQ ID NO: 2579 - DNA, 495 bp, Artificial Sequence
  Oligonucleotide
gcctccctcgcgccatcagaagtaacgctataaggtcagctcagccaaaaccctgcggctggtagggggcctgtggggctgggggctgatgtggctgcggtctccagggcgggtcgggtccaggggcccccagcagtcgacaagtaacgctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattgaagtaacgctataaggctgagcgggctggcaaggc

SEQ ID NO: 2580 - DNA, 495 bp, Artificial Sequence
  Oligonucleotide
gcctccctcgcgccatcagaagtaacgtcttagtctcagctcagccaaaaccctgcggctggtagggggcctgtggggctgggggctgatgtggctgcggtctccagggcgggtcgggtccaggggcccccagcagtcgacaagtaacgtcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcaagtaacgtcttagtcctgagcgggctggcaaggc

SEQ ID NO: 2581 - DNA, 495 bp, Artificial Sequence
  Oligonucleotide
gcctccctcgcgccatcagaagtaacgtgtctgcatcagctcagccaaaaccctgcggctggtagggggcctgtggggctgggggctgatgtggctgcggtctccagggcgggtcgggtccaggggcccccagcagtcgacaagtaacgtgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccaagtaacgtgtctgcactgagcgggctggcaaggc

SEQ ID NO: 2582 - DNA, 495 bp, Artificial Sequence
  Oligonucleotide
gcctccctcgcgccatcagaagtaacggccattaatcagctcagccaaaaccctgcggctggtagggggcctgtggggctgggggctgatgtggctgcggtctccagggcgggtcgggtccaggggcccccagcagtcgacaagtaacggccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcaagtaacggccattaactgagcgggctggcaaggc

SEQ ID NO: 2583 - DNA, 495 bp, Artificial Sequence
  Oligonucleotide
gcctccctcgcgccatcagaagtaacggactaagatcagctcagccaaaaccctgcggctggtagggggcctgtggggctgggggctgatgtggctgcggtctccagggcgggtcgggtccaggggcccccagcagtcgacaagtaacggactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactgaagtaacggactaagactgagcgggctggcaaggc

SEQ ID NO: 2584 - DNA, 495 bp, Artificial Sequence
  Oligonucleotide
gcctccctcgcgccatcagaagtaacgaggttgcttcagctcagccaaaaccctgcggctggtagggggcctgtggggctgggggctgatgtggctgcggtctccagggcgggtcgggtccaggggcccccagcagtcgacaagtaacgaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactgaagtaacgaggttgctctgagcgggctggcaaggc

SEQ ID NO: 2585 - DNA, 495 bp, Artificial Sequence
  Oligonucleotide
gcctccctcgcgccatcagaagtaacgctcgagaatcagctcagccaaaaccctgcggctggtagggggcctgtggggctgggggctgatgtggctgcggtctccagggcgggtcgggtccaggggcccccagcagtcgacaagtaacgctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccaagtaacgctcgagaactgagcgggctggcaaggc

SEQ ID NO: 2586 - DNA, 495 bp, Artificial Sequence
  Oligonucleotide
gcctccctcgcgccatcagaagtaacgttaatggctcagctcagccaaaaccctgcggctggtagggggcctgtggggctgggggctgatgtggctgcggtctccagggcgggtcgggtccaggggcccccagcagtcgacaagtaacgttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccaagtaacgttaatggcctgagcgggctggcaaggc

SEQ ID NO: 2587 - DNA, 495 bp, Artificial Sequence
  Oligonucleotide
gcctccctcgcgccatcagaagtaacgtgcagacatcagctcagccaaaaccctgcggctggtagggggcctgtggggctgggggctgatgtggctgcggtctccagggcgggtcgggtccaggggcccccagcagtcgacaagtaacgtgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaaaagtaacgtgcagacactgagcgggctggcaaggc

SEQ ID NO: 2588 - DNA, 495 bp, Artificial Sequence
  Oligonucleotide
gcctccctcgcgccatcagaagtaacgtcactgagtcagctcagccaaaaccctgcggctggtagggggcctgtggggctgggggctgatgtggctgcggtctccagggcgggtcgggtccaggggcccccagcagtcgacaagtaacgtcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtaagtaacgtcactgagctgagcgggctggcaaggc

SEQ ID NO: 2589 - DNA, 495 bp, Artificial Sequence
  Oligonucleotide
gcctccctcgcgccatcagaagtaacggagtacgttcagctcagccaaaaccctgcggctggtagggggcctgtggggctgggggctgatgtggctgcggtctccagggcgggtcgggtccaggggcccccagcagtcgacaagtaacggagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacaagtaacggagtacgtctgagcgggctggcaaggc

SEQ ID NO: 2590 - DNA, 495 bp, Artificial Sequence
  Oligonucleotide
gcctccctcgcgccatcagaagtaacgatacgccatcagctcagccaaaaccctgcggctggtagggggcctgtggggctgggggctgatgtggctgcggtctccagggcgggtcgggtccaggggcccccagcagtcgacaagtaacgatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacaagtaacgatacgccactgagcgggctggcaaggc

SEQ ID NO: 2591 - DNA, 495 bp, Artificial Sequence
  Oligonucleotide
gcctccctcgcgccatcagaagtaacgtcgcatcatcagctcagccaaaaccctgcggctggtagggggcctgtggggctgggggctgatgtggctgcggtctccagggcgggtcgggtccaggggcccccagcagtcgacaagtaacgtcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacaagtaacgtcgcatcactgagcgggctggcaaggc

SEQ ID NO: 2592 - DNA, 495 bp, Artificial Sequence
  Oligonucleotide
gcctccctcgcgccatcagaagtaacgcgcttaattcagctcagccaaaaccctgcggctggtagggggcctgtggggctgggggctgatgtggctgcggtctccagggcgggtcgggtccaggggcccccagcagtcgacaagtaacgcgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacaagtaacgcgcttaatctgagcgggctggcaaggc

SEQ ID NO: 2593 - DNA, 495 bp, Artificial Sequence
  Oligonucleotide
gcctccctcgcgccatcagaagtaacgtggttatctcagctcagccaaaaccctgcggctggtagggggcctgtggggctgggggctgatgtggctgcggtctccagggcgggtcgggtccaggggcccccagcagtcgacaagtaacgtggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtaagtaacgtggttatcctgagcgggctggcaaggc

SEQ ID NO: 2594 - DNA, 495 bp, Artificial Sequence
  Oligonucleotide
gcctccctcgcgccatcagaagtaacgggattgcttcagctcagccaaaaccctgcggctggtagggggcctgtggggctgggggctgatgtggctgcggtctccagggcgggtcgggtccaggggcccccagcagtcgacaagtaacgggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacaagtaacgggattgctctgagcgggctggcaaggc

SEQ ID NO: 2595 - DNA, 495 bp, Artificial Sequence
  Oligonucleotide
gcctccctcgcgccatcagaagtaacgctcagtgatcagctcagccaaaaccctgcggctggtagggggcctgtggggctgggggctgatgtggctgcggtctccagggcgggtcgggtccaggggcccccagcagtcgacaagtaacgctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtaagtaacgctcagtgactgagcgggctggcaaggc

SEQ ID NO: 2596 - DNA, 495 bp, Artificial Sequence
  Oligonucleotide
gcctccctcgcgccatcagaagtaacgacgtactctcagctcagccaaaaccctgcggctggtagggggcctgtggggctgggggctgatgtggctgcggtctccagggcgggtcgggtccaggggcccccagcagtcgacaagtaacgacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacaagtaacgacgtactcctgagcgggctggcaaggc

SEQ ID NO: 2597 - DNA, 495 bp, Artificial Sequence
  Oligonucleotide
gcctccctcgcgccatcagaagtaacgtgatgcgatcagctcagccaaaaccctgcggctggtagggggcctgtggggctgggggctgatgtggctgcggtctccagggcgggtcgggtccaggggcccccagcagtcgacaagtaacgtgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccaagtaacgtgatgcgactgagcgggctggcaaggc

SEQ ID NO: 2598 - DNA, 495 bp, Artificial Sequence
  Oligonucleotide
gcctccctcgcgccatcagaagtaacgattaagcgtcagctcagccaaaaccctgcggctggtagggggcctgtggggctgggggctgatgtggctgcggtctccagggcgggtcgggtccaggggcccccagcagtcgacaagtaacgattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccaagtaacgattaagcgctgagcgggctggcaaggc

SEQ ID NO: 2599 - DNA, 495 bp, Artificial Sequence
  Oligonucleotide
gcctccctcgcgccatcagaagtaacgagcaatcctcagctcagccaaaaccctgcggctggtagggggcctgtggggctgggggctgatgtggctgcggtctccagggcgggtcgggtccaggggcccccagcagtcgacaagtaacgagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccaagtaacgagcaatccctgagcgggctggcaaggc

SEQ ID NO: 2600 - DNA, 495 bp, Artificial Sequence
  Oligonucleotide
gcctccctcgcgccatcagaagtaacggcttagtatcagctcagccaaaaccctgcggctggtagggggcctgtggggctgggggctgatgtggctgcggtctccagggcgggtcgggtccaggggcccccagcagtcgacaagtaacggcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgaaagtaacggcttagtactgagcgggctggcaaggc

SEQ ID NO: 2601 - DNA, 495 bp, Artificial Sequence
  Oligonucleotide
gcctccctcgcgccatcagaagtaacgtgaccttgtcagctcagccaaaaccctgcggctggtagggggcctgtggggctgggggctgatgtggctgcggtctccagggcgggtcgggtccaggggcccccagcagtcgacaagtaacgtgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccaagtaacgtgaccttgctgagcgggctggcaaggc

SEQ ID NO: 2602 - DNA, 495 bp, Artificial Sequence
  Oligonucleotide
gcctccctcgcgccatcagaagtaacgcaaggtcatcagctcagccaaaaccctgcggctggtagggggcctgtggggctgggggctgatgtggctgcggtctccagggcgggtcgggtccaggggcccccagcagtcgacaagtaacgcaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccaagtaacgcaaggtcactgagcgggctggcaaggc

SEQ ID NO: 2603 - DNA, 495 bp, Artificial Sequence
  Oligonucleotide
gcctccctcgcgccatcagaagtaacgcactgtactcagctcagccaaaaccctgcggctggtagggggcctgtggggctgggggctgatgtggctgcggtctccagggcgggtcgggtccaggggcccccagcagtcgacaagtaacgcactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcaagtaacgcactgtacctgagcgggctggcaaggc

SEQ ID NO: 2604 - DNA, 495 bp, Artificial Sequence
  Oligonucleotide
gcctccctcgcgccatcagaagtaacggatgatcctcagctcagccaaaaccctgcggctggtagggggcctgtggggctgggggctgatgtggctgcggtctccagggcgggtcgggtccaggggcccccagcagtcgacaagtaacggatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcataggaagtaacggatgatccctgagcgggctggcaaggc

SEQ ID NO: 2605 - DNA, 495 bp, Artificial Sequence
  Oligonucleotide
gcctccctcgcgccatcagaagtaacgcgccaatatcagctcagccaaaaccctgcggctggtagggggcctgtggggctgggggctgatgtggctgcggtctccagggcgggtcgggtccaggggcccccagcagtcgacaagtaacgcgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacaggaagtaacgcgccaatactgagcgggctggcaaggc

SEQ ID NO: 2606 - DNA, 495 bp, Artificial Sequence
  Oligonucleotide
gcctccctcgcgccatcagaagtaacgtcaagccttcagctcagccaaaaccctgcggctggtagggggcctgtggggctgggggctgatgtggctgcggtctccagggcgggtcgggtccaggggcccccagcagtcgacaagtaacgtcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacaaagtaacgtcaagcctctgagcgggctggcaaggc

SEQ ID NO: 2607 - DNA, 495 bp, Artificial Sequence
  Oligonucleotide
gcctccctcgcgccatcagaagtaacgacgtgtgttcagctcagccaaaaccctgcggctggtagggggcctgtggggctgggggctgatgtggctgcggtctccagggcgggtcgggtccaggggcccccagcagtcgacaagtaacgacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagaagtaacgacgtgtgtctgagcgggctggcaaggc

SEQ ID NO: 2608 - DNA, 495 bp, Artificial Sequence
  Oligonucleotide
gcctccctcgcgccatcagaagtaacgtccgtctatcagctcagccaaaaccctgcggctggtagggggcctgtggggctgggggctgatgtggctgcggtctccagggcgggtcgggtccaggggcccccagcagtcgacaagtaacgtccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagaagtaacgtccgtctactgagcgggctggcaaggc

SEQ ID NO: 2609 - DNA, 495 bp, Artificial Sequence
  Oligonucleotide
gcctccctcgcgccatcagaagtaacgaagagctgtcagctcagccaaaaccctgcggctggtagggggcctgtggggctgggggctgatgtggctgcggtctccagggcgggtcgggtccaggggcccccagcagtcgacaagtaacgaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacgaagtaacgaagagctgctgagcgggctggcaaggc

SEQ ID NO: 2610 - DNA, 495 bp, Artificial Sequence
  Oligonucleotide
gcctccctcgcgccatcagaagtaacgtatcgctctcagctcagccaaaaccctgcggctggtagggggcctgtggggctgggggctgatgtggctgcggtctccagggcgggtcgggtccaggggcccccagcagtcgacaagtaacgtatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcagaagtaacgtatcgctcctgagcgggctggcaaggc

SEQ ID NO: 2611 - DNA, 495 bp, Artificial Sequence
  Oligonucleotide
gcctccctcgcgccatcagaagtaacgtcagatgctcagctcagccaaaaccctgcggctggtagggggcctgtggggctgggggctgatgtggctgcggtctccagggcgggtcgggtccaggggcccccagcagtcgacaagtaacgtcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccaagtaacgtcagatgcctgagcgggctggcaaggc

SEQ ID NO: 2612 - DNA, 495 bp, Artificial Sequence
  Oligonucleotide
gcctccctcgcgccatcagaagtaacggtgtagcatcagctcagccaaaaccctgcggctggtagggggcctgtggggctgggggctgatgtggctgcggtctccagggcgggtcgggtccaggggcccccagcagtcgacaagtaacggtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtgaagtaacggtgtagcactgagcgggctggcaaggc

SEQ ID NO: 2613 - DNA, 495 bp, Artificial Sequence
  Oligonucleotide
gcctccctcgcgccatcagaagtaacgtggcagtttcagctcagccaaaaccctgcggctggtagggggcctgtggggctgggggctgatgtggctgcggtctccagggcgggtcgggtccaggggcccccagcagtcgacaagtaacgtggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctgaagtaacgtggcagttctgagcgggctggcaaggc

SEQ ID NO: 2614 - DNA, 495 bp, Artificial Sequence
  Oligonucleotide
gcctccctcgcgccatcagaagtaacgcagtccaatcagctcagccaaaaccctgcggctggtagggggcctgtggggctgggggctgatgtggctgcggtctccagggcgggtcgggtccaggggcccccagcagtcgacaagtaacgcagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacaagtaacgcagtccaactgagcgggctggcaaggc

SEQ ID NO: 2615 - DNA, 495 bp, Artificial Sequence
  Oligonucleotide
gcctccctcgcgccatcagaagtaacggtgtctactcagctcagccaaaaccctgcggctggtagggggcctgtggggctgggggctgatgtggctgcggtctccagggcgggtcgggtccaggggcccccagcagtcgacaagtaacggtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctggaagtaacggtgtctacctgagcgggctggcaaggc

SEQ ID NO: 2616 - DNA, 495 bp, Artificial Sequence
  Oligonucleotide
gcctccctcgcgccatcagaagtaacggtacagtgtcagctcagccaaaaccctgcggctggtagggggcctgtggggctgggggctgatgtggctgcggtctccagggcgggtcgggtccaggggcccccagcagtcgacaagtaacggtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacagaagtaacggtacagtgctgagcgggctggcaaggc

SEQ ID NO: 2617 - DNA, 495 bp, Artificial Sequence
  Oligonucleotide
gcctccctcgcgccatcagaagtaacgggatcatctcagctcagccaaaaccctgcggctggtagggggcctgtggggctgggggctgatgtggctgcggtctccagggcgggtcgggtccaggggcccccagcagtcgacaagtaacgggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacagaagtaacgggatcatcctgagcgggctggcaaggc

SEQ ID NO: 2618 - DNA, 495 bp, Artificial Sequence
  Oligonucleotide
gcctccctcgcgccatcagaagtaacgtattggcgtcagctcagccaaaaccctgcggctggtagggggcctgtggggctgggggctgatgtggctgcggtctccagggcgggtcgggtccaggggcccccagcagtcgacaagtaacgtattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcaaagtaacgtattggcgctgagcgggctggcaaggc

SEQ ID NO: 2619 - DNA, 495 bp, Artificial Sequence
  Oligonucleotide
gcctccctcgcgccatcagaagtaacgaggcttgatcagctcagccaaaaccctgcggctggtagggggcctgtggggctgggggctgatgtggctgcggtctccagggcgggtcgggtccaggggcccccagcagtcgacaagtaacgaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacaagtaacgaggcttgactgagcgggctggcaaggc

SEQ ID NO: 2620 - DNA, 495 bp, Artificial Sequence
  Oligonucleotide
gcctccctcgcgccatcagaagtaacgacacacgttcagctcagccaaaaccctgcggctggtagggggcctgtggggctgggggctgatgtggctgcggtctccagggcgggtcgggtccaggggcccccagcagtcgacaagtaacgacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcataagtaacgacacacgtctgagcgggctggcaaggc

SEQ ID NO: 2621 - DNA, 495 bp, Artificial Sequence
  Oligonucleotide
gcctccctcgcgccatcagaagtaacgtagacggatcagctcagccaaaaccctgcggctggtagggggcctgtggggctgggggctgatgtggctgcggtctccagggcgggtcgggtccaggggcccccagcagtcgacaagtaacgtagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaaagtaacgtagacggactgagcgggctggcaaggc

SEQ ID NO: 2622 - DNA, 495 bp, Artificial Sequence
  Oligonucleotide
gcctccctcgcgccatcagaagtaacggagcgatatcagctcagccaaaaccctgcggctggtagggggcctgtggggctgggggctgatgtggctgcggtctccagggcgggtcgggtccaggggcccccagcagtcgacaagtaacggagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttaagtaacggagcgatactgagcgggctggcaaggc

SEQ ID NO: 2623 - DNA, 495 bp, Artificial Sequence
  Oligonucleotide
gcctccctcgcgccatcagaagtaacggcatctgatcagctcagccaaaaccctgcggctggtagggggcctgtggggctgggggctgatgtggctgcggtctccagggcgggtcgggtccaggggcccccagcagtcgacaagtaacggcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacaaagtaacggcatctgactgagcgggctggcaaggc

SEQ ID NO: 2624 - DNA, 495 bp, Artificial Sequence
  Oligonucleotide
gcctccctcgcgccatcagaagtaacgtgctacactcagctcagccaaaaccctgcggctggtagggggcctgtggggctgggggctgatgtggctgcggtctccagggcgggtcgggtccaggggcccccagcagtcgacaagtaacgtgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctgaagtaacgtgctacacctgagcgggctggcaaggc

SEQ ID NO: 2625 - DNA, 495 bp, Artificial Sequence
  Oligonucleotide
gcctccctcgcgccatcagaagtaacgaactgccatcagctcagccaaaaccctgcggctggtagggggcctgtggggctgggggctgatgtggctgcggtctccagggcgggtcgggtccaggggcccccagcagtcgacaagtaacgaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttaagtaacgaactgccactgagcgggctggcaaggc

SEQ ID NO: 2626 - DNA, 495 bp, Artificial Sequence
  Oligonucleotide
gcctccctcgcgccatcagaagtaacgttggactgtcagctcagccaaaaccctgcggctggtagggggcctgtggggctgggggctgatgtggctgcggtctccagggcgggtcgggtccaggggcccccagcagtcgacaagtaacgttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagaggaagtaacgttggactgctgagcgggctggcaaggc

SEQ ID NO: 2627 - DNA, 495 bp, Artificial Sequence
  Oligonucleotide
gcctccctcgcgccatcagaagtaacgtcggtacttcagctcagccaaaaccctgcggctggtagggggcctgtggggctgggggctgatgtggctgcggtctccagggcgggtcgggtccaggggcccccagcagtcgacaagtaacgtcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctgaagtaacgtcggtactctgagcgggctggcaaggc

SEQ ID NO: 2628 - DNA, 495 bp, Artificial Sequence
  Oligonucleotide
gcctccctcgcgccatcagaagtaacgccatggattcagctcagccaaaaccctgcggctggtagggggcctgtggggctgggggctgatgtggctgcggtctccagggcgggtcgggtccaggggcccccagcagtcgacaagtaacgccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacaagtaacgccatggatctgagcgggctggcaaggc

SEQ ID NO: 2629 - DNA, 495 bp, Artificial Sequence
  Oligonucleotide
gcctccctcgcgccatcagaagtaacgacgaagattcagctcagccaaaaccctgcggctggtagggggcctgtggggctgggggctgatgtggctgcggtctccagggcgggtcgggtccaggggcccccagcagtcgacaagtaacgacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaaaagtaacgacgaagatctgagcgggctggcaaggc

SEQ ID NO: 2630 - DNA, 495 bp, Artificial Sequence
  Oligonucleotide
gcctccctcgcgccatcagaagtaacgactgtggatcagctcagccaaaaccctgcggctggtagggggcctgtggggctgggggctgatgtggctgcggtctccagggcgggtcgggtccaggggcccccagcagtcgacaagtaacgactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttaagtaacgactgtggactgagcgggctggcaaggc

SEQ ID NO: 2631 - DNA, 495 bp, Artificial Sequence
  Oligonucleotide
gcctccctcgcgccatcagaagtaacgggtgtcattcagctcagccaaaaccctgcggctggtagggggcctgtggggctgggggctgatgtggctgcggtctccagggcgggtcgggtccaggggcccccagcagtcgacaagtaacgggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctaagtaacgggtgtcatctgagcgggctggcaaggc

SEQ ID NO: 2632 - DNA, 495 bp, Artificial Sequence
  Oligonucleotide
gcctccctcgcgccatcagaagtaacgtcgtgaagtcagctcagccaaaaccctgcggctggtagggggcctgtggggctgggggctgatgtggctgcggtctccagggcgggtcgggtccaggggcccccagcagtcgacaagtaacgtcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagaggaagtaacgtcgtgaagctgagcgggctggcaaggc

SEQ ID NO: 2633 - DNA, 495 bp, Artificial Sequence
  Oligonucleotide
gcctccctcgcgccatcagaagtaacgcactagcttcagctcagccaaaaccctgcggctggtagggggcctgtggggctgggggctgatgtggctgcggtctccagggcgggtcgggtccaggggcccccagcagtcgacaagtaacgcactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaaaagtaacgcactagctctgagcgggctggcaaggc

SEQ ID NO: 2634 - DNA, 495 bp, Artificial Sequence
  Oligonucleotide
gcctccctcgcgccatcagaagtaacgggtcaacttcagctcagccaaaaccctgcggctggtagggggcctgtggggctgggggctgatgtggctgcggtctccagggcgggtcgggtccaggggcccccagcagtcgacaagtaacgggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggaaagtaacgggtcaactctgagcgggctggcaaggc

SEQ ID NO: 2635 - DNA, 495 bp, Artificial Sequence
  Oligonucleotide
gcctccctcgcgccatcagaagtaacgtacgtacgtcagctcagccaaaaccctgcggctggtagggggcctgtggggctgggggctgatgtggctgcggtctccagggcgggtcgggtccaggggcccccagcagtcgacaagtaacgtacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcaagtaacgtacgtacgctgagcgggctggcaaggc

SEQ ID NO: 2636 - DNA, 495 bp, Artificial Sequence
  Oligonucleotide
gcctccctcgcgccatcagaagtaacgatgacacctcagctcagccaaaaccctgcggctggtagggggcctgtggggctgggggctgatgtggctgcggtctccagggcgggtcgggtccaggggcccccagcagtcgacaagtaacgatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactggaagtaacgatgacaccctgagcgggctggcaaggc

SEQ ID NO: 2637 - DNA, 495 bp, Artificial Sequence
  Oligonucleotide
gcctccctcgcgccatcagaagtaacgcttcacgatcagctcagccaaaaccctgcggctggtagggggcctgtggggctgggggctgatgtggctgcggtctccagggcgggtcgggtccaggggcccccagcagtcgacaagtaacgcttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacaagtaacgcttcacgactgagcgggctggcaaggc

SEQ ID NO: 2638 - DNA, 495 bp, Artificial Sequence
  Oligonucleotide
gcctccctcgcgccatcagaagtaacgagaatcagtcagctcagccaaaaccctgcggctggtagggggcctgtggggctgggggctgatgtggctgcggtctccagggcgggtcgggtccaggggcccccagcagtcgacaagtaacgagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccaagtaacgagaatcagctgagcgggctggcaaggc

SEQ ID NO: 2639 - DNA, 495 bp, Artificial Sequence
  Oligonucleotide
gcctccctcgcgccatcagaagtaacgagttatgctcagctcagccaaaaccctgcggctggtagggggcctgtggggctgggggctgatgtggctgcggtctccagggcgggtcgggtccaggggcccccagcagtcgacaagtaacgagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataaaagtaacgagttatgcctgagcgggctggcaaggc

SEQ ID NO: 2640 - DNA, 495 bp, Artificial Sequence
  Oligonucleotide
gcctccctcgcgccatcagaagtaacgaggtctcatcagctcagccaaaaccctgcggctggtagggggcctgtggggctgggggctgatgtggctgcggtctccagggcgggtcgggtccaggggcccccagcagtcgacaagtaacgaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccaagtaacgaggtctcactgagcgggctggcaaggc

SEQ ID NO: 2641 - DNA, 495 bp, Artificial Sequence
  Oligonucleotide
gcctccctcgcgccatcagaagtaacggtcatagttcagctcagccaaaaccctgcggctggtagggggcctgtggggctgggggctgatgtggctgcggtctccagggcgggtcgggtccaggggcccccagcagtcgacaagtaacggtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtaagtaacggtcatagtctgagcgggctggcaaggc

SEQ ID NO: 2642 - DNA, 495 bp, Artificial Sequence
  Oligonucleotide
gcctccctcgcgccatcagaagtaacggtgacttgtcagctcagccaaaaccctgcggctggtagggggcctgtggggctgggggctgatgtggctgcggtctccagggcgggtcgggtccaggggcccccagcagtcgacaagtaacggtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactgaagtaacggtgacttgctgagcgggctggcaaggc

SEQ ID NO: 2643 - DNA, 495 bp, Artificial Sequence
  Oligonucleotide
gcctccctcgcgccatcagaagtaacggattgcagtcagctcagccaaaaccctgcggctggtagggggcctgtggggctgggggctgatgtggctgcggtctccagggcgggtcgggtccaggggcccccagcagtcgacaagtaacggattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccaagtaacggattgcagctgagcgggctggcaaggc

SEQ ID NO: 2644 - DNA, 495 bp, Artificial Sequence
  Oligonucleotide
gcctccctcgcgccatcagaagtaacgactatgactcagctcagccaaaaccctgcggctggtagggggcctgtggggctgggggctgatgtggctgcggtctccagggcgggtcgggtccaggggcccccagcagtcgacaagtaacgactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacaagtaacgactatgacctgagcgggctggcaaggc

SEQ ID NO: 2645 - DNA, 495 bp, Artificial Sequence
  Oligonucleotide
gcctccctcgcgccatcagaagtaacgatggtcaatcagctcagccaaaaccctgcggctggtagggggcctgtggggctgggggctgatgtggctgcggtctccagggcgggtcgggtccaggggcccccagcagtcgacaagtaacgatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacaagtaacgatggtcaactgagcgggctggcaaggc

SEQ ID NO: 2646 - DNA, 495 bp, Artificial Sequence
  Oligonucleotide
gcctccctcgcgccatcagaagtaacggatggctttcagctcagccaaaaccctgcggctggtagggggcctgtggggctgggggctgatgtggctgcggtctccagggcgggtcgggtccaggggcccccagcagtcgacaagtaacggatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacaagtaacggatggcttctgagcgggctggcaaggc

SEQ ID NO: 2647 - DNA, 495 bp, Artificial Sequence
  Oligonucleotide
gcctccctcgcgccatcagaagtaacgagcatatgtcagctcagccaaaaccctgcggctggtagggggcctgtggggctgggggctgatgtggctgcggtctccagggcgggtcgggtccaggggcccccagcagtcgacaagtaacgagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacaagtaacgagcatatgctgagcgggctggcaaggc

SEQ ID NO: 2648 - DNA, 495 bp, Artificial Sequence
  Oligonucleotide
gcctccctcgcgccatcagaagtaacgcatatgcttcagctcagccaaaaccctgcggctggtagggggcctgtggggctgggggctgatgtggctgcggtctccagggcgggtcgggtccaggggcccccagcagtcgacaagtaacgcatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactgaagtaacgcatatgctctgagcgggctggcaaggc

SEQ ID NO: 2649 - DNA, 495 bp, Artificial Sequence
  Oligonucleotide
gcctccctcgcgccatcagaagtaacgtcgtcgattcagctcagccaaaaccctgcggctggtagggggcctgtggggctgggggctgatgtggctgcggtctccagggcgggtcgggtccaggggcccccagcagtcgacaagtaacgtcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccaagtaacgtcgtcgatctgagcgggctggcaaggc

SEQ ID NO: 2650 - DNA, 495 bp, Artificial Sequence
  Oligonucleotide
gcctccctcgcgccatcagaagtaacgcagtctgttcagctcagccaaaaccctgcggctggtagggggcctgtggggctgggggctgatgtggctgcggtctccagggcgggtcgggtccaggggcccccagcagtcgacaagtaacgcagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcaagtaacgcagtctgtctgagcgggctggcaaggc

SEQ ID NO: 2651 - DNA, 495 bp, Artificial Sequence
  Oligonucleotide
gcctccctcgcgccatcagaagtaacgaacgcgtatcagctcagccaaaaccctgcggctggtagggggcctgtggggctgggggctgatgtggctgcggtctccagggcgggtcgggtccaggggcccccagcagtcgacaagtaacgaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacgaagtaacgaacgcgtactgagcgggctggcaaggc

SEQ ID NO: 2652 - DNA, 495 bp, Artificial Sequence
  Oligonucleotide
gcctccctcgcgccatcagaagtaacggtagttcgtcagctcagccaaaaccctgcggctggtagggggcctgtggggctgggggctgatgtggctgcggtctccagggcgggtcgggtccaggggcccccagcagtcgacaagtaacggtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcaagtaacggtagttcgctgagcgggctggcaaggc

SEQ ID NO: 2653 - DNA, 495 bp, Artificial Sequence
  Oligonucleotide
gcctccctcgcgccatcagaagtaacgcgaactactcagctcagccaaaaccctgcggctggtagggggcctgtggggctgggggctgatgtggctgcggtctccagggcgggtcgggtccaggggcccccagcagtcgacaagtaacgcgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacaagtaacgcgaactacctgagcgggctggcaaggc

SEQ ID NO: 2654 - DNA, 495 bp, Artificial Sequence
  Oligonucleotide
gcctccctcgcgccatcagaagtaacgttaacgtctcagctcagccaaaaccctgcggctggtagggggcctgtggggctgggggctgatgtggctgcggtctccagggcgggtcgggtccaggggcccccagcagtcgacaagtaacgttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccaagtaacgttaacgtcctgagcgggctggcaaggc

SEQ ID NO: 2655 - DNA, 495 bp, Artificial Sequence
  Oligonucleotide
gcctccctcgcgccatcagaagtaacgagcaaccttcagctcagccaaaaccctgcggctggtagggggcctgtggggctgggggctgatgtggctgcggtctccagggcgggtcgggtccaggggcccccagcagtcgacaagtaacgagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacaagtaacgagcaacctctgagcgggctggcaaggc

SEQ ID NO: 2656 - DNA, 495 bp, Artificial Sequence
  Oligonucleotide
gcctccctcgcgccatcagaagtaacgttctcgagtcagctcagccaaaaccctgcggctggtagggggcctgtggggctgggggctgatgtggctgcggtctccagggcgggtcgggtccaggggcccccagcagtcgacaagtaacgttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttaagtaacgttctcgagctgagcgggctggcaaggc

SEQ ID NO: 2657 - DNA, 495 bp, Artificial Sequence
  Oligonucleotide
gcctccctcgcgccatcagaagtaacgactctacgtcagctcagccaaaaccctgcggctggtagggggcctgtggggctgggggctgatgtggctgcggtctccagggcgggtcgggtccaggggcccccagcagtcgacaagtaacgactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacaagtaacgactctacgctgagcgggctggcaaggc

SEQ ID NO: 2658 - DNA, 495 bp, Artificial Sequence
  Oligonucleotide
gcctccctcgcgccatcagaagtaacgtaccggaatcagctcagccaaaaccctgcggctggtagggggcctgtggggctgggggctgatgtggctgcggtctccagggcgggtcgggtccaggggcccccagcagtcgacaagtaacgtaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccaagtaacgtaccggaactgagcgggctggcaaggc

SEQ ID NO: 2659 - DNA, 495 bp, Artificial Sequence
  Oligonucleotide
gcctccctcgcgccatcagaagtaacgcgaattgctcagctcagccaaaaccctgcggctggtagggggcctgtggggctgggggctgatgtggctgcggtctccagggcgggtcgggtccaggggcccccagcagtcgacaagtaacgcgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacaagtaacgcgaattgcctgagcgggctggcaaggc

SEQ ID NO: 2660 - DNA, 495 bp, Artificial Sequence
  Oligonucleotide
gcctccctcgcgccatcagaagtaacgttcgctcatcagctcagccaaaaccctgcggctggtagggggcctgtggggctgggggctgatgtggctgcggtctccagggcgggtcgggtccaggggcccccagcagtcgacaagtaacgttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacaaagtaacgttcgctcactgagcgggctggcaaggc

SEQ ID NO: 2661 - DNA, 495 bp, Artificial Sequence
  Oligonucleotide
gcctccctcgcgccatcagaagtaacggacgttaatcagctcagccaaaaccctgcggctggtagggggcctgtggggctgggggctgatgtggctgcggtctccagggcgggtcgggtccaggggcccccagcagtcgacaagtaacggacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactgaagtaacggacgttaactgagcgggctggcaaggc

SEQ ID NO: 2662 - DNA, 495 bp, Artificial Sequence
  Oligonucleotide
gcctccctcgcgccatcagaagtaacgcgtagagttcagctcagccaaaaccctgcggctggtagggggcctgtggggctgggggctgatgtggctgcggtctccagggcgggtcgggtccaggggcccccagcagtcgacaagtaacgcgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcaagtaacgcgtagagtctgagcgggctggcaaggc

SEQ ID NO: 2663 - DNA, 495 bp, Artificial Sequence
  Oligonucleotide
gcctccctcgcgccatcagaagtaacgttccggtatcagctcagccaaaaccctgcggctggtagggggcctgtggggctgggggctgatgtggctgcggtctccagggcgggtcgggtccaggggcccccagcagtcgacaagtaacgttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcaagtaacgttccggtactgagcgggctggcaaggc

SEQ ID NO: 2664 - DNA, 495 bp, Artificial Sequence
  Oligonucleotide
gcctccctcgcgccatcagaagtaacggcaattcgtcagctcagccaaaaccctgcggctggtagggggcctgtggggctgggggctgatgtggctgcggtctccagggcgggtcgggtccaggggcccccagcagtcgacaagtaacggcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacaagtaacggcaattcgctgagcgggctggcaaggc

SEQ ID NO: 2665 - DNA, 495 bp, Artificial Sequence
  Oligonucleotide
gcctccctcgcgccatcagaagtaacgtgagcgaatcagctcagccaaaaccctgcggctggtagggggcctgtggggctgggggctgatgtggctgcggtctccagggcgggtcgggtccaggggcccccagcagtcgacaagtaacgtgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcaagtaacgtgagcgaactgagcgggctggcaaggc

SEQ ID NO: 2666 - DNA, 495 bp, Artificial Sequence
  Oligonucleotide
gcctccctcgcgccatcagaagtaacgtactaagctcagctcagccaaaaccctgcggctggtagggggcctgtggggctgggggctgatgtggctgcggtctccagggcgggtcgggtccaggggcccccagcagtcgacaagtaacgtactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccaagtaacgtactaagcctgagcgggctggcaaggc

SEQ ID NO: 2667 - DNA, 495 bp, Artificial Sequence
  Oligonucleotide
gcctccctcgcgccatcagaagtaacgtggcgtattcagctcagccaaaaccctgcggctggtagggggcctgtggggctgggggctgatgtggctgcggtctccagggcgggtcgggtccaggggcccccagcagtcgacaagtaacgtggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtaagtaacgtggcgtatctgagcgggctggcaaggc

SEQ ID NO: 2668 - DNA, 495 bp, Artificial Sequence
  Oligonucleotide
gcctccctcgcgccatcagaagtaacggataaccatcagctcagccaaaaccctgcggctggtagggggcctgtggggctgggggctgatgtggctgcggtctccagggcgggtcgggtccaggggcccccagcagtcgacaagtaacggataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctgaagtaacggataaccactgagcgggctggcaaggc

SEQ ID NO: 2669 - DNA, 495 bp, Artificial Sequence
  Oligonucleotide
gcctccctcgcgccatcagaagtaacgctagtgaatcagctcagccaaaaccctgcggctggtagggggcctgtggggctgggggctgatgtggctgcggtctccagggcgggtcgggtccaggggcccccagcagtcgacaagtaacgctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggagaagtaacgctagtgaactgagcgggctggcaaggc

SEQ ID NO: 2670 - DNA, 495 bp, Artificial Sequence
  Oligonucleotide
gcctccctcgcgccatcagaagtaacgacgttcactcagctcagccaaaaccctgcggctggtagggggcctgtggggctgggggctgatgtggctgcggtctccagggcgggtcgggtccaggggcccccagcagtcgacaagtaacgacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtaagtaacgacgttcacctgagcgggctggcaaggc

SEQ ID NO: 2671 - DNA, 448 bp, Artificial Sequence
  Oligonucleotide
gcctccctcgcgccatcagaagtaacgattacgcttcagctcagccaaaaccctgcggctggtagggggcctgtggggctgggggctgatgtggctgcggtctccagggcgggtcgggtccaggggcccccagcagtcgacaagtaacgattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcaaagtaacgattacgctctgagcgggctggcaaggc

SEQ ID NO: 2672 - DNA, 495 bp, Artificial Sequence
  Oligonucleotide
gcctccctcgcgccatcagaagtaacgcattgagttcagctcagccaaaaccctgcggctggtagggggcctgtggggctgggggctgatgtggctgcggtctccagggcgggtcgggtccaggggcccccagcagtcgacaagtaacgcattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccaagtaacgcattgagtctgagcgggctggcaaggc

SEQ ID NO: 2673 - DNA, 495 bp, Artificial Sequence
  Oligonucleotide
gcctccctcgcgccatcaggtctcctacttggttaccagccacacagacccccgggctgagacccaggcagggaggggtgacgttcccagggagacggtggccgggctgccctggccccagtgctccaagcacttgtcgacgtctcctacttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgtctcctacttggttactgagcgggctggcaaggc

SEQ ID NO: 2674 - DNA, 495 bp, Artificial Sequence
  Oligonucleotide
gcctccctcgcgccatcaggtctcctaacctcttgccagccacacagacccccgggctgagacccaggcagggaggggtgacgttcccagggagacggtggccgggctgccctggccccagtgctccaagcacttgtcgacgtctcctaacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgtctcctaacctcttgctgagcgggctggcaaggc

SEQ ID NO: 2675 - DNA, 495 bp, Artificial Sequence
  Oligonucleotide
gcctccctcgcgccatcaggtctcctactgattctccagccacacagacccccgggctgagacccaggcagggaggggtgacgttcccagggagacggtggccgggctgccctggccccagtgctccaagcacttgtcgacgtctcctactgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgtctcctactgattctctgagcgggctggcaaggc

SEQ ID NO: 2676 - DNA, 495 bp, Artificial Sequence
  Oligonucleotide
gcctccctcgcgccatcaggtctcctaagtaccgaccagccacacagacccccgggctgagacccaggcagggaggggtgacgttcccagggagacggtggccgggctgccctggccccagtgctccaagcacttgtcgacgtctcctaagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgtctcctaagtaccgactgagcgggctggcaaggc

SEQ ID NO: 2677 - DNA, 495 bp, Artificial Sequence
  Oligonucleotide
gcctccctcgcgccatcaggtctcctaatccatggccagccacacagacccccgggctgagacccaggcagggaggggtgacgttcccagggagacggtggccgggctgccctggccccagtgctccaagcacttgtcgacgtctcctaatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgtctcctaatccatggctgagcgggctggcaaggc

SEQ ID NO: 2678 - DNA, 495 bp, Artificial Sequence
  Oligonucleotide
gcctccctcgcgccatcaggtctcctagtagcagtccagccacacagacccccgggctgagacccaggcagggaggggtgacgttcccagggagacggtggccgggctgccctggccccagtgctccaagcacttgtcgacgtctcctagtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgtctcctagtagcagtctgagcgggctggcaaggc

SEQ ID NO: 2679 - DNA, 495 bp, Artificial Sequence
  Oligonucleotide
gcctccctcgcgccatcaggtctcctaatcttcgtccagccacacagacccccgggctgagacccaggcagggaggggtgacgttcccagggagacggtggccgggctgccctggccccagtgctccaagcacttgtcgacgtctcctaatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgtctcctaatcttcgtctgagcgggctggcaaggc

SEQ ID NO: 2680 - DNA, 495 bp, Artificial Sequence
  Oligonucleotide
gcctccctcgcgccatcaggtctcctatccacagtccagccacacagacccccgggctgagacccaggcagggaggggtgacgttcccagggagacggtggccgggctgccctggccccagtgctccaagcacttgtcgacgtctcctatccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgtctcctatccacagtctgagcgggctggcaaggc

SEQ ID NO: 2681 - DNA, 495 bp, Artificial Sequence
  Oligonucleotide
gcctccctcgcgccatcaggtctcctaagctagtgccagccacacagacccccgggctgagacccaggcagggaggggtgacgttcccagggagacggtggccgggctgccctggccccagtgctccaagcacttgtcgacgtctcctaagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgtctcctaagctagtgctgagcgggctggcaaggc

SEQ ID NO: 2682 - DNA, 495 bp, Artificial Sequence
  Oligonucleotide
gcctccctcgcgccatcaggtctcctataaccaagccagccacacagacccccgggctgagacccaggcagggaggggtgacgttcccagggagacggtggccgggctgccctggccccagtgctccaagcacttgtcgacgtctcctataaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgtctcctataaccaagctgagcgggctggcaaggc

SEQ ID NO: 2683 - DNA, 495 bp, Artificial Sequence
  Oligonucleotide
gcctccctcgcgccatcaggtctcctacaagaggtccagccacacagacccccgggctgagacccaggcagggaggggtgacgttcccagggagacggtggccgggctgccctggccccagtgctccaagcacttgtcgacgtctcctacaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgtctcctacaagaggtctgagcgggctggcaaggc

SEQ ID NO: 2684 - DNA, 495 bp, Artificial Sequence
  Oligonucleotide
gcctccctcgcgccatcaggtctcctaagttgaccccagccacacagacccccgggctgagacccaggcagggaggggtgacgttcccagggagacggtggccgggctgccctggccccagtgctccaagcacttgtcgacgtctcctaagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagtctcctaagttgaccctgagcgggctggcaaggc

SEQ ID NO: 2685 - DNA, 495 bp, Artificial Sequence
  Oligonucleotide
gcctccctcgcgccatcaggtctcctacagcatatccagccacacagacccccgggctgagacccaggcagggaggggtgacgttcccagggagacggtggccgggctgccctggccccagtgctccaagcacttgtcgacgtctcctacagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagtctcctacagcatatctgagcgggctggcaaggc

SEQ ID NO: 2686 - DNA, 495 bp, Artificial Sequence
  Oligonucleotide
gcctccctcgcgccatcaggtctcctagcaggattccagccacacagacccccgggctgagacccaggcagggaggggtgacgttcccagggagacggtggccgggctgccctggccccagtgctccaagcacttgtcgacgtctcctagcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagtctcctagcaggattctgagcgggctggcaaggc

SEQ ID NO: 2687 - DNA, 495 bp, Artificial Sequence
  Oligonucleotide
gcctccctcgcgccatcaggtctcctagtccattcccagccacacagacccccgggctgagacccaggcagggaggggtgacgttcccagggagacggtggccgggctgccctggccccagtgctccaagcacttgtcgacgtctcctagtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgtctcctagtccattcctgagcgggctggcaaggc

SEQ ID NO: 2688 - DNA, 495 bp, Artificial Sequence
  Oligonucleotide
gcctccctcgcgccatcaggtctcctagcataactccagccacacagacccccgggctgagacccaggcagggaggggtgacgttcccagggagacggtggccgggctgccctggccccagtgctccaagcacttgtcgacgtctcctagcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgtctcctagcataactctgagcgggctggcaaggc

SEQ ID NO: 2689 - DNA, 495 bp, Artificial Sequence
  Oligonucleotide
gcctccctcgcgccatcaggtctcctaatatgctgccagccacacagacccccgggctgagacccaggcagggaggggtgacgttcccagggagacggtggccgggctgccctggccccagtgctccaagcacttgtcgacgtctcctaatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgtctcctaatatgctgctgagcgggctggcaaggc

SEQ ID NO: 2690 - DNA, 495 bp, Artificial Sequence
  Oligonucleotide
gcctccctcgcgccatcaggtctcctaaatcctgcccagccacacagacccccgggctgagacccaggcagggaggggtgacgttcccagggagacggtggccgggctgccctggccccagtgctccaagcacttgtcgacgtctcctaaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgtctcctaaatcctgcctgagcgggctggcaaggc

SEQ ID NO: 2691 - DNA, 495 bp, Artificial Sequence
  Oligonucleotide
gcctccctcgcgccatcaggtctcctatgagacctccagccacacagacccccgggctgagacccaggcagggaggggtgacgttcccagggagacggtggccgggctgccctggccccagtgctccaagcacttgtcgacgtctcctatgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggtctcctatgagacctctgagcgggctggcaaggc

SEQ ID NO: 2692 - DNA, 495 bp, Artificial Sequence
  Oligonucleotide
gcctccctcgcgccatcaggtctcctagaatggacccagccacacagacccccgggctgagacccaggcagggaggggtgacgttcccagggagacggtggccgggctgccctggccccagtgctccaagcacttgtcgacgtctcctagaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgtctcctagaatggacctgagcgggctggcaaggc

SEQ ID NO: 2693 - DNA, 495 bp, Artificial Sequence
  Oligonucleotide
gcctccctcgcgccatcaggtctcctacacatggaccagccacacagacccccgggctgagacccaggcagggaggggtgacgttcccagggagacggtggccgggctgccctggccccagtgctccaagcacttgtcgacgtctcctacacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgtctcctacacatggactgagcgggctggcaaggc

SEQ ID NO: 2694 - DNA, 495 bp, Artificial Sequence
  Oligonucleotide
gcctccctcgcgccatcaggtctcctattgaccatccagccacacagacccccgggctgagacccaggcagggaggggtgacgttcccagggagacggtggccgggctgccctggccccagtgctccaagcacttgtcgacgtctcctattgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgtctcctattgaccatctgagcgggctggcaaggc

SEQ ID NO: 2695 - DNA, 495 bp, Artificial Sequence
  Oligonucleotide
gcctccctcgcgccatcaggtctcctaaagccatcccagccacacagacccccgggctgagacccaggcagggaggggtgacgttcccagggagacggtggccgggctgccctggccccagtgctccaagcacttgtcgacgtctcctaaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgtctcctaaagccatcctgagcgggctggcaaggc

SEQ ID NO: 2696 - DNA, 495 bp, Artificial Sequence
  Oligonucleotide
gcctccctcgcgccatcaggtctcctatccatgtgccagccacacagacccccgggctgagacccaggcagggaggggtgacgttcccagggagacggtggccgggctgccctggccccagtgctccaagcacttgtcgacgtctcctatccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtctcctatccatgtgctgagcgggctggcaaggc

SEQ ID NO: 2697 - DNA, 495 bp, Artificial Sequence
  Oligonucleotide
gcctccctcgcgccatcaggtctcctacaagtcacccagccacacagacccccgggctgagacccaggcagggaggggtgacgttcccagggagacggtggccgggctgccctggccccagtgctccaagcacttgtcgacgtctcctacaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtctcctacaagtcacctgagcgggctggcaaggc

SEQ ID NO: 2698 - DNA, 495 bp, Artificial Sequence
  Oligonucleotide
gcctccctcgcgccatcaggtctcctactgcaatcccagccacacagacccccgggctgagacccaggcagggaggggtgacgttcccagggagacggtggccgggctgccctggccccagtgctccaagcacttgtcgacgtctcctactgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgtctcctactgcaatcctgagcgggctggcaaggc

SEQ ID NO: 2699 - DNA, 495 bp, Artificial Sequence
  Oligonucleotide
gcctccctcgcgccatcaggtctcctaatcgacgaccagccacacagacccccgggctgagacccaggcagggaggggtgacgttcccagggagacggtggccgggctgccctggccccagtgctccaagcacttgtcgacgtctcctaatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgtctcctaatcgacgactgagcgggctggcaaggc

SEQ ID NO: 2700 - DNA, 495 bp, Artificial Sequence
  Oligonucleotide
gcctccctcgcgccatcaggtctcctaacagactgccagccacacagacccccgggctgagacccaggcagggaggggtgacgttcccagggagacggtggccgggctgccctggccccagtgctccaagcacttgtcgacgtctcctaacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagtctcctaacagactgctgagcgggctggcaaggc

SEQ ID NO: 2701 - DNA, 495 bp, Artificial Sequence
  Oligonucleotide
gcctccctcgcgccatcaggtctcctaccttatagccagccacacagacccccgggctgagacccaggcagggaggggtgacgttcccagggagacggtggccgggctgccctggccccagtgctccaagcacttgtcgacgtctcctaccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgtctcctaccttatagctgagcgggctggcaaggc

SEQ ID NO: 2702 - DNA, 495 bp, Artificial Sequence
  Oligonucleotide
gcctccctcgcgccatcaggtctcctatacgcgttccagccacacagacccccgggctgagacccaggcagggaggggtgacgttcccagggagacggtggccgggctgccctggccccagtgctccaagcacttgtcgacgtctcctatacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgtctcctatacgcgttctgagcgggctggcaaggc

SEQ ID NO: 2703 - DNA, 495 bp, Artificial Sequence
  Oligonucleotide
gcctccctcgcgccatcaggtctcctactataaggccagccacacagacccccgggctgagacccaggcagggaggggtgacgttcccagggagacggtggccgggctgccctggccccagtgctccaagcacttgtcgacgtctcctactataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggtctcctactataaggctgagcgggctggcaaggc

SEQ ID NO: 2704 - DNA, 495 bp, Artificial Sequence
  Oligonucleotide
gcctccctcgcgccatcaggtctcctatcttagtcccagccacacagacccccgggctgagacccaggcagggaggggtgacgttcccagggagacggtggccgggctgccctggccccagtgctccaagcacttgtcgacgtctcctatcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtctcctatcttagtcctgagcgggctggcaaggc

SEQ ID NO: 2705 - DNA, 495 bp, Artificial Sequence
  Oligonucleotide
gcctccctcgcgccatcaggtctcctatgtctgcaccagccacacagacccccgggctgagacccaggcagggaggggtgacgttcccagggagacggtggccgggctgccctggccccagtgctccaagcacttgtcgacgtctcctatgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgtctcctatgtctgcactgagcgggctggcaaggc

SEQ ID NO: 2706 - DNA, 495 bp, Artificial Sequence
  Oligonucleotide
gcctccctcgcgccatcaggtctcctagccattaaccagccacacagacccccgggctgagacccaggcagggaggggtgacgttcccagggagacggtggccgggctgccctggccccagtgctccaagcacttgtcgacgtctcctagccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtctcctagccattaactgagcgggctggcaaggc

SEQ ID NO: 2707 - DNA, 495 bp, Artificial Sequence
  Oligonucleotide
gcctccctcgcgccatcaggtctcctagactaagaccagccacacagacccccgggctgagacccaggcagggaggggtgacgttcccagggagacggtggccgggctgccctggccccagtgctccaagcacttgtcgacgtctcctagactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggtctcctagactaagactgagcgggctggcaaggc

SEQ ID NO: 2708 - DNA, 495 bp, Artificial Sequence
  Oligonucleotide
gcctccctcgcgccatcaggtctcctaaggttgctccagccacacagacccccgggctgagacccaggcagggaggggtgacgttcccagggagacggtggccgggctgccctggccccagtgctccaagcacttgtcgacgtctcctaaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggtctcctaaggttgctctgagcgggctggcaaggc

SEQ ID NO: 2709 - DNA, 495 bp, Artificial Sequence
  Oligonucleotide
gcctccctcgcgccatcaggtctcctactcgagaaccagccacacagacccccgggctgagacccaggcagggaggggtgacgttcccagggagacggtggccgggctgccctggccccagtgctccaagcacttgtcgacgtctcctactcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgtctcctactcgagaactgagcgggctggcaaggc

SEQ ID NO: 2710 - DNA, 495 bp, Artificial Sequence
  Oligonucleotide
gcctccctcgcgccatcaggtctcctattaatggcccagccacacagacccccgggctgagacccaggcagggaggggtgacgttcccagggagacggtggccgggctgccctggccccagtgctccaagcacttgtcgacgtctcctattaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgtctcctattaatggcctgagcgggctggcaaggc

SEQ ID NO: 2711 - DNA, 495 bp, Artificial Sequence
  Oligonucleotide
gcctccctcgcgccatcaggtctcctatgcagacaccagccacacagacccccgggctgagacccaggcagggaggggtgacgttcccagggagacggtggccgggctgccctggccccagtgctccaagcacttgtcgacgtctcctatgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagtctcctatgcagacactgagcgggctggcaaggc

SEQ ID NO: 2712 - DNA, 495 bp, Artificial Sequence
  Oligonucleotide
gcctccctcgcgccatcaggtctcctatcactgagccagccacacagacccccgggctgagacccaggcagggaggggtgacgttcccagggagacggtggccgggctgccctggccccagtgctccaagcacttgtcgacgtctcctatcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgtctcctatcactgagctgagcgggctggcaaggc

SEQ ID NO: 2713 - DNA, 495 bp, Artificial Sequence
  Oligonucleotide
gcctccctcgcgccatcaggtctcctagagtacgtccagccacacagacccccgggctgagacccaggcagggaggggtgacgttcccagggagacggtggccgggctgccctggccccagtgctccaagcacttgtcgacgtctcctagagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgtctcctagagtacgtctgagcgggctggcaaggc

SEQ ID NO: 2714 - DNA, 495 bp, Artificial Sequence
  Oligonucleotide
gcctccctcgcgccatcaggtctcctaatacgccaccagccacacagacccccgggctgagacccaggcagggaggggtgacgttcccagggagacggtggccgggctgccctggccccagtgctccaagcacttgtcgacgtctcctaatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgtctcctaatacgccactgagcgggctggcaaggc

SEQ ID NO: 2715 - DNA, 495 bp, Artificial Sequence
  Oligonucleotide
gcctccctcgcgccatcaggtctcctatcgcatcaccagccacacagacccccgggctgagacccaggcagggaggggtgacgttcccagggagacggtggccgggctgccctggccccagtgctccaagcacttgtcgacgtctcctatcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgtctcctatcgcatcactgagcgggctggcaaggc

SEQ ID NO: 2716 - DNA, 495 bp, Artificial Sequence
  Oligonucleotide
gcctccctcgcgccatcaggtctcctacgcttaatccagccacacagacccccgggctgagacccaggcagggaggggtgacgttcccagggagacggtggccgggctgccctggccccagtgctccaagcacttgtcgacgtctcctacgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgtctcctacgcttaatctgagcgggctggcaaggc

SEQ ID NO: 2717 - DNA, 495 bp, Artificial Sequence
  Oligonucleotide
gcctccctcgcgccatcaggtctcctatggttatcccagccacacagacccccgggctgagacccaggcagggaggggtgacgttcccagggagacggtggccgggctgccctggccccagtgctccaagcacttgtcgacgtctcctatggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgtctcctatggttatcctgagcgggctggcaaggc

SEQ ID NO: 2718 - DNA, 495 bp, Artificial Sequence
  Oligonucleotide
gcctccctcgcgccatcaggtctcctaggattgctccagccacacagacccccgggctgagacccaggcagggaggggtgacgttcccagggagacggtggccgggctgccctggccccagtgctccaagcacttgtcgacgtctcctaggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgtctcctaggattgctctgagcgggctggcaaggc

SEQ ID NO: 2719 - DNA, 495 bp, Artificial Sequence
  Oligonucleotide
gcctccctcgcgccatcaggtctcctactcagtgaccagccacacagacccccgggctgagacccaggcagggaggggtgacgttcccagggagacggtggccgggctgccctggccccagtgctccaagcacttgtcgacgtctcctactcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgtctcctactcagtgactgagcgggctggcaaggc

SEQ ID NO: 2720 - DNA, 495 bp, Artificial Sequence
  Oligonucleotide
gcctccctcgcgccatcaggtctcctaacgtactcccagccacacagacccccgggctgagacccaggcagggaggggtgacgttcccagggagacggtggccgggctgccctggccccagtgctccaagcacttgtcgacgtctcctaacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgtctcctaacgtactcctgagcgggctggcaaggc

SEQ ID NO: 2721 - DNA, 495 bp, Artificial Sequence
  Oligonucleotide
gcctccctcgcgccatcaggtctcctatgatgcgaccagccacacagacccccgggctgagacccaggcagggaggggtgacgttcccagggagacggtggccgggctgccctggccccagtgctccaagcacttgtcgacgtctcctatgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgtctcctatgatgcgactgagcgggctggcaaggc

SEQ ID NO: 2722 - DNA, 495 bp, Artificial Sequence
  Oligonucleotide
gcctccctcgcgccatcaggtctcctaattaagcgccagccacacagacccccgggctgagacccaggcagggaggggtgacgttcccagggagacggtggccgggctgccctggccccagtgctccaagcacttgtcgacgtctcctaattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgtctcctaattaagcgctgagcgggctggcaaggc

SEQ ID NO: 2723 - DNA, 495 bp, Artificial Sequence
  Oligonucleotide
gcctccctcgcgccatcaggtctcctaagcaatccccagccacacagacccccgggctgagacccaggcagggaggggtgacgttcccagggagacggtggccgggctgccctggccccagtgctccaagcacttgtcgacgtctcctaagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgtctcctaagcaatccctgagcgggctggcaaggc

SEQ ID NO: 2724 - DNA, 495 bp, Artificial Sequence
  Oligonucleotide
gcctccctcgcgccatcaggtctcctagcttagtaccagccacacagacccccgggctgagacccaggcagggaggggtgacgttcccagggagacggtggccgggctgccctggccccagtgctccaagcacttgtcgacgtctcctagcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagtctcctagcttagtactgagcgggctggcaaggc

SEQ ID NO: 2725 - DNA, 495 bp, Artificial Sequence
  Oligonucleotide
gcctccctcgcgccatcaggtctcctatgaccttgccagccacacagacccccgggctgagacccaggcagggaggggtgacgttcccagggagacggtggccgggctgccctggccccagtgctccaagcacttgtcgacgtctcctatgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgtctcctatgaccttgctgagcgggctggcaaggc

SEQ ID NO: 2726 - DNA, 495 bp, Artificial Sequence
  Oligonucleotide
gcctccctcgcgccatcaggtctcctacaaggtcaccagccacacagacccccgggctgagacccaggcagggaggggtgacgttcccagggagacggtggccgggctgccctggccccagtgctccaagcacttgtcgacgtctcctacaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgtctcctacaaggtcactgagcgggctggcaaggc

SEQ ID NO: 2727 - DNA, 495 bp, Artificial Sequence
  Oligonucleotide
gcctccctcgcgccatcaggtctcctacactgtacccagccacacagacccccgggctgagacccaggcagggaggggtgacgttcccagggagacggtggccgggctgccctggccccagtgctccaagcacttgtcgacgtctcctacactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgtctcctacactgtacctgagcgggctggcaaggc

SEQ ID NO: 2728 - DNA, 495 bp, Artificial Sequence
  Oligonucleotide
gcctccctcgcgccatcaggtctcctagatgatccccagccacacagacccccgggctgagacccaggcagggaggggtgacgttcccagggagacggtggccgggctgccctggccccagtgctccaagcacttgtcgacgtctcctagatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggtctcctagatgatccctgagcgggctggcaaggc

SEQ ID NO: 2729 - DNA, 495 bp, Artificial Sequence
  Oligonucleotide
gcctccctcgcgccatcaggtctcctacgccaataccagccacacagacccccgggctgagacccaggcagggaggggtgacgttcccagggagacggtggccgggctgccctggccccagtgctccaagcacttgtcgacgtctcctacgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggtctcctacgccaatactgagcgggctggcaaggc

SEQ ID NO: 2730 - DNA, 495 bp, Artificial Sequence
  Oligonucleotide
gcctccctcgcgccatcaggtctcctatcaagcctccagccacacagacccccgggctgagacccaggcagggaggggtgacgttcccagggagacggtggccgggctgccctggccccagtgctccaagcacttgtcgacgtctcctatcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagtctcctatcaagcctctgagcgggctggcaaggc

SEQ ID NO: 2731 - DNA, 495 bp, Artificial Sequence
  Oligonucleotide
gcctccctcgcgccatcaggtctcctaacgtgtgtccagccacacagacccccgggctgagacccaggcagggaggggtgacgttcccagggagacggtggccgggctgccctggccccagtgctccaagcacttgtcgacgtctcctaacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggtctcctaacgtgtgtctgagcgggctggcaaggc

SEQ ID NO: 2732 - DNA, 495 bp, Artificial Sequence
  Oligonucleotide
gcctccctcgcgccatcaggtctcctatccgtctaccagccacacagacccccgggctgagacccaggcagggaggggtgacgttcccagggagacggtggccgggctgccctggccccagtgctccaagcacttgtcgacgtctcctatccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggtctcctatccgtctactgagcgggctggcaaggc

SEQ ID NO: 2733 - DNA, 495 bp, Artificial Sequence
  Oligonucleotide
gcctccctcgcgccatcaggtctcctaaagagctgccagccacacagacccccgggctgagacccaggcagggaggggtgacgttcccagggagacggtggccgggctgccctggccccagtgctccaagcacttgtcgacgtctcctaaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggtctcctaaagagctgctgagcgggctggcaaggc

SEQ ID NO: 2734 - DNA, 495 bp, Artificial Sequence
  Oligonucleotide
gcctccctcgcgccatcaggtctcctatatcgctcccagccacacagacccccgggctgagacccaggcagggaggggtgacgttcccagggagacggtggccgggctgccctggccccagtgctccaagcacttgtcgacgtctcctatatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggtctcctatatcgctcctgagcgggctggcaaggc

SEQ ID NO: 2735 - DNA, 495 bp, Artificial Sequence
  Oligonucleotide
gcctccctcgcgccatcaggtctcctatcagatgcccagccacacagacccccgggctgagacccaggcagggaggggtgacgttcccagggagacggtggccgggctgccctggccccagtgctccaagcacttgtcgacgtctcctatcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgtctcctatcagatgcctgagcgggctggcaaggc

SEQ ID NO: 2736 - DNA, 495 bp, Artificial Sequence
  Oligonucleotide
gcctccctcgcgccatcaggtctcctagtgtagcaccagccacacagacccccgggctgagacccaggcagggaggggtgacgttcccagggagacggtggccgggctgccctggccccagtgctccaagcacttgtcgacgtctcctagtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggtctcctagtgtagcactgagcgggctggcaaggc

SEQ ID NO: 2737 - DNA, 495 bp, Artificial Sequence
  Oligonucleotide
gcctccctcgcgccatcaggtctcctatggcagttccagccacacagacccccgggctgagacccaggcagggaggggtgacgttcccagggagacggtggccgggctgccctggccccagtgctccaagcacttgtcgacgtctcctatggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggtctcctatggcagttctgagcgggctggcaaggc

SEQ ID NO: 2738 - DNA, 495 bp, Artificial Sequence
  Oligonucleotide
gcctccctcgcgccatcaggtctcctacagtccaaccagccacacagacccccgggctgagacccaggcagggaggggtgacgttcccagggagacggtggccgggctgccctggccccagtgctccaagcacttgtcgacgtctcctacagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgtctcctacagtccaactgagcgggctggcaaggc

SEQ ID NO: 2739 - DNA, 495 bp, Artificial Sequence
  Oligonucleotide
gcctccctcgcgccatcaggtctcctagtgtctacccagccacacagacccccgggctgagacccaggcagggaggggtgacgttcccagggagacggtggccgggctgccctggccccagtgctccaagcacttgtcgacgtctcctagtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggtctcctagtgtctacctgagcgggctggcaaggc

SEQ ID NO: 2740 - DNA, 495 bp, Artificial Sequence
  Oligonucleotide
gcctccctcgcgccatcaggtctcctagtacagtgccagccacacagacccccgggctgagacccaggcagggaggggtgacgttcccagggagacggtggccgggctgccctggccccagtgctccaagcacttgtcgacgtctcctagtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggtctcctagtacagtgctgagcgggctggcaaggc

SEQ ID NO: 2741 - DNA, 495 bp, Artificial Sequence
  Oligonucleotide
gcctccctcgcgccatcaggtctcctaggatcatcccagccacacagacccccgggctgagacccaggcagggaggggtgacgttcccagggagacggtggccgggctgccctggccccagtgctccaagcacttgtcgacgtctcctaggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggtctcctaggatcatcctgagcgggctggcaaggc

SEQ ID NO: 2742 - DNA, 495 bp, Artificial Sequence
  Oligonucleotide
gcctccctcgcgccatcaggtctcctatattggcgccagccacacagacccccgggctgagacccaggcagggaggggtgacgttcccagggagacggtggccgggctgccctggccccagtgctccaagcacttgtcgacgtctcctatattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagtctcctatattggcgctgagcgggctggcaaggc

SEQ ID NO: 2743 - DNA, 495 bp, Artificial Sequence
  Oligonucleotide
gcctccctcgcgccatcaggtctcctaaggcttgaccagccacacagacccccgggctgagacccaggcagggaggggtgacgttcccagggagacggtggccgggctgccctggccccagtgctccaagcacttgtcgacgtctcctaaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgtctcctaaggcttgactgagcgggctggcaaggc

SEQ ID NO: 2744 - DNA, 495 bp, Artificial Sequence
  Oligonucleotide
gcctccctcgcgccatcaggtctcctaacacacgtccagccacacagacccccgggctgagacccaggcagggaggggtgacgttcccagggagacggtggccgggctgccctggccccagtgctccaagcacttgtcgacgtctcctaacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgtctcctaacacacgtctgagcgggctggcaaggc

SEQ ID NO: 2745 - DNA, 495 bp, Artificial Sequence
  Oligonucleotide
gcctccctcgcgccatcaggtctcctatagacggaccagccacacagacccccgggctgagacccaggcagggaggggtgacgttcccagggagacggtggccgggctgccctggccccagtgctccaagcacttgtcgacgtctcctatagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagtctcctatagacggactgagcgggctggcaaggc

SEQ ID NO: 2746 - DNA, 495 bp, Artificial Sequence
  Oligonucleotide
gcctccctcgcgccatcaggtctcctagagcgataccagccacacagacccccgggctgagacccaggcagggaggggtgacgttcccagggagacggtggccgggctgccctggccccagtgctccaagcacttgtcgacgtctcctagagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgtctcctagagcgatactgagcgggctggcaaggc

SEQ ID NO: 2747 - DNA, 495 bp, Artificial Sequence
  Oligonucleotide
gcctccctcgcgccatcaggtctcctagcatctgaccagccacacagacccccgggctgagacccaggcagggaggggtgacgttcccagggagacggtggccgggctgccctggccccagtgctccaagcacttgtcgacgtctcctagcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagtctcctagcatctgactgagcgggctggcaaggc

SEQ ID NO: 2748 - DNA, 495 bp, Artificial Sequence
  Oligonucleotide
gcctccctcgcgccatcaggtctcctatgctacacccagccacacagacccccgggctgagacccaggcagggaggggtgacgttcccagggagacggtggccgggctgccctggccccagtgctccaagcacttgtcgacgtctcctatgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggtctcctatgctacacctgagcgggctggcaaggc

SEQ ID NO: 2749 - DNA, 495 bp, Artificial Sequence
  Oligonucleotide
gcctccctcgcgccatcaggtctcctaaactgccaccagccacacagacccccgggctgagacccaggcagggaggggtgacgttcccagggagacggtggccgggctgccctggccccagtgctccaagcacttgtcgacgtctcctaaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgtctcctaaactgccactgagcgggctggcaaggc

SEQ ID NO: 2750 - DNA, 495 bp, Artificial Sequence
  Oligonucleotide
gcctccctcgcgccatcaggtctcctattggactgccagccacacagacccccgggctgagacccaggcagggaggggtgacgttcccagggagacggtggccgggctgccctggccccagtgctccaagcacttgtcgacgtctcctattggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggtctcctattggactgctgagcgggctggcaaggc

SEQ ID NO: 2751 - DNA, 495 bp, Artificial Sequence
  Oligonucleotide
gcctccctcgcgccatcaggtctcctatcggtactccagccacacagacccccgggctgagacccaggcagggaggggtgacgttcccagggagacggtggccgggctgccctggccccagtgctccaagcacttgtcgacgtctcctatcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggtctcctatcggtactctgagcgggctggcaaggc

SEQ ID NO: 2752 - DNA, 495 bp, Artificial Sequence
  Oligonucleotide
gcctccctcgcgccatcaggtctcctaccatggatccagccacacagacccccgggctgagacccaggcagggaggggtgacgttcccagggagacggtggccgggctgccctggccccagtgctccaagcacttgtcgacgtctcctaccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgtctcctaccatggatctgagcgggctggcaaggc

SEQ ID NO: 2753 - DNA, 495 bp, Artificial Sequence
  Oligonucleotide
gcctccctcgcgccatcaggtctcctaacgaagatccagccacacagacccccgggctgagacccaggcagggaggggtgacgttcccagggagacggtggccgggctgccctggccccagtgctccaagcacttgtcgacgtctcctaacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagtctcctaacgaagatctgagcgggctggcaaggc

SEQ ID NO: 2754 - DNA, 495 bp, Artificial Sequence
  Oligonucleotide
gcctccctcgcgccatcaggtctcctaactgtggaccagccacacagacccccgggctgagacccaggcagggaggggtgacgttcccagggagacggtggccgggctgccctggccccagtgctccaagcacttgtcgacgtctcctaactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgtctcctaactgtggactgagcgggctggcaaggc

SEQ ID NO: 2755 - DNA, 495 bp, Artificial Sequence
  Oligonucleotide
gcctccctcgcgccatcaggtctcctaggtgtcatccagccacacagacccccgggctgagacccaggcagggaggggtgacgttcccagggagacggtggccgggctgccctggccccagtgctccaagcacttgtcgacgtctcctaggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgtctcctaggtgtcatctgagcgggctggcaaggc

SEQ ID NO: 2756 - DNA, 495 bp, Artificial Sequence
  Oligonucleotide
gcctccctcgcgccatcaggtctcctatcgtgaagccagccacacagacccccgggctgagacccaggcagggaggggtgacgttcccagggagacggtggccgggctgccctggccccagtgctccaagcacttgtcgacgtctcctatcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggtctcctatcgtgaagctgagcgggctggcaaggc

SEQ ID NO: 2757 - DNA, 495 bp, Artificial Sequence
  Oligonucleotide
gcctccctcgcgccatcaggtctcctacactagctccagccacacagacccccgggctgagacccaggcagggaggggtgacgttcccagggagacggtggccgggctgccctggccccagtgctccaagcacttgtcgacgtctcctacactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagtctcctacactagctctgagcgggctggcaaggc

SEQ ID NO: 2758 - DNA, 495 bp, Artificial Sequence
  Oligonucleotide
gcctccctcgcgccatcaggtctcctaggtcaactccagccacacagacccccgggctgagacccaggcagggaggggtgacgttcccagggagacggtggccgggctgccctggccccagtgctccaagcacttgtcgacgtctcctaggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagtctcctaggtcaactctgagcgggctggcaaggc

SEQ ID NO: 2759 - DNA, 495 bp, Artificial Sequence
  Oligonucleotide
gcctccctcgcgccatcaggtctcctatacgtacgccagccacacagacccccgggctgagacccaggcagggaggggtgacgttcccagggagacggtggccgggctgccctggccccagtgctccaagcacttgtcgacgtctcctatacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgtctcctatacgtacgctgagcgggctggcaaggc

SEQ ID NO: 2760 - DNA, 495 bp, Artificial Sequence
  Oligonucleotide
gcctccctcgcgccatcaggtctcctaatgacaccccagccacacagacccccgggctgagacccaggcagggaggggtgacgttcccagggagacggtggccgggctgccctggccccagtgctccaagcacttgtcgacgtctcctaatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggtctcctaatgacaccctgagcgggctggcaaggc

SEQ ID NO: 2761 - DNA, 495 bp, Artificial Sequence
  Oligonucleotide
gcctccctcgcgccatcaggtctcctacttcacgaccagccacacagacccccgggctgagacccaggcagggaggggtgacgttcccagggagacggtggccgggctgccctggccccagtgctccaagcacttgtcgacgtctcctacttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgtctcctacttcacgactgagcgggctggcaaggc

SEQ ID NO: 2762 - DNA, 495 bp, Artificial Sequence
  Oligonucleotide
gcctccctcgcgccatcaggtctcctaagaatcagccagccacacagacccccgggctgagacccaggcagggaggggtgacgttcccagggagacggtggccgggctgccctggccccagtgctccaagcacttgtcgacgtctcctaagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgtctcctaagaatcagctgagcgggctggcaaggc

SEQ ID NO: 2763 - DNA, 495 bp, Artificial Sequence
  Oligonucleotide
gcctccctcgcgccatcaggtctcctaagttatgcccagccacacagacccccgggctgagacccaggcagggaggggtgacgttcccagggagacggtggccgggctgccctggccccagtgctccaagcacttgtcgacgtctcctaagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagtctcctaagttatgcctgagcgggctggcaaggc

SEQ ID NO: 2764 - DNA, 495 bp, Artificial Sequence
  Oligonucleotide
gcctccctcgcgccatcaggtctcctaaggtctcaccagccacacagacccccgggctgagacccaggcagggaggggtgacgttcccagggagacggtggccgggctgccctggccccagtgctccaagcacttgtcgacgtctcctaaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgtctcctaaggtctcactgagcgggctggcaaggc

SEQ ID NO: 2765 - DNA, 495 bp, Artificial Sequence
  Oligonucleotide
gcctccctcgcgccatcaggtctcctagtcatagtccagccacacagacccccgggctgagacccaggcagggaggggtgacgttcccagggagacggtggccgggctgccctggccccagtgctccaagcacttgtcgacgtctcctagtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgtctcctagtcatagtctgagcgggctggcaaggc

SEQ ID NO: 2766 - DNA, 495 bp, Artificial Sequence
  Oligonucleotide
gcctccctcgcgccatcaggtctcctagtgacttgccagccacacagacccccgggctgagacccaggcagggaggggtgacgttcccagggagacggtggccgggctgccctggccccagtgctccaagcacttgtcgacgtctcctagtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggtctcctagtgacttgctgagcgggctggcaaggc

SEQ ID NO: 2767 - DNA, 495 bp, Artificial Sequence
  Oligonucleotide
gcctccctcgcgccatcaggtctcctagattgcagccagccacacagacccccgggctgagacccaggcagggaggggtgacgttcccagggagacggtggccgggctgccctggccccagtgctccaagcacttgtcgacgtctcctagattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgtctcctagattgcagctgagcgggctggcaaggc

SEQ ID NO: 2768 - DNA, 495 bp, Artificial Sequence
  Oligonucleotide
gcctccctcgcgccatcaggtctcctaactatgacccagccacacagacccccgggctgagacccaggcagggaggggtgacgttcccagggagacggtggccgggctgccctggccccagtgctccaagcacttgtcgacgtctcctaactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgtctcctaactatgacctgagcgggctggcaaggc

SEQ ID NO: 2769 - DNA, 495 bp, Artificial Sequence
  Oligonucleotide
gcctccctcgcgccatcaggtctcctaatggtcaaccagccacacagacccccgggctgagacccaggcagggaggggtgacgttcccagggagacggtggccgggctgccctggccccagtgctccaagcacttgtcgacgtctcctaatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgtctcctaatggtcaactgagcgggctggcaaggc

SEQ ID NO: 2770 - DNA, 495 bp, Artificial Sequence
  Oligonucleotide
gcctccctcgcgccatcaggtctcctagatggcttccagccacacagacccccgggctgagacccaggcagggaggggtgacgttcccagggagacggtggccgggctgccctggccccagtgctccaagcacttgtcgacgtctcctagatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgtctcctagatggcttctgagcgggctggcaaggc

SEQ ID NO: 2771 - DNA, 495 bp, Artificial Sequence
  Oligonucleotide
gcctccctcgcgccatcaggtctcctaagcatatgccagccacacagacccccgggctgagacccaggcagggaggggtgacgttcccagggagacggtggccgggctgccctggccccagtgctccaagcacttgtcgacgtctcctaagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgtctcctaagcatatgctgagcgggctggcaaggc

SEQ ID NO: 2772 - DNA, 495 bp, Artificial Sequence
  Oligonucleotide
gcctccctcgcgccatcaggtctcctacatatgctccagccacacagacccccgggctgagacccaggcagggaggggtgacgttcccagggagacggtggccgggctgccctggccccagtgctccaagcacttgtcgacgtctcctacatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggtctcctacatatgctctgagcgggctggcaaggc

SEQ ID NO: 2773 - DNA, 495 bp, Artificial Sequence
  Oligonucleotide
gcctccctcgcgccatcaggtctcctatcgtcgatccagccacacagacccccgggctgagacccaggcagggaggggtgacgttcccagggagacggtggccgggctgccctggccccagtgctccaagcacttgtcgacgtctcctatcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgtctcctatcgtcgatctgagcgggctggcaaggc

SEQ ID NO: 2774 - DNA, 495 bp, Artificial Sequence
  Oligonucleotide
gcctccctcgcgccatcaggtctcctacagtctgtccagccacacagacccccgggctgagacccaggcagggaggggtgacgttcccagggagacggtggccgggctgccctggccccagtgctccaagcacttgtcgacgtctcctacagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgtctcctacagtctgtctgagcgggctggcaaggc

SEQ ID NO: 2775 - DNA, 495 bp, Artificial Sequence
  Oligonucleotide
gcctccctcgcgccatcaggtctcctaaacgcgtaccagccacacagacccccgggctgagacccaggcagggaggggtgacgttcccagggagacggtggccgggctgccctggccccagtgctccaagcacttgtcgacgtctcctaaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggtctcctaaacgcgtactgagcgggctggcaaggc

SEQ ID NO: 2776 - DNA, 495 bp, Artificial Sequence
  Oligonucleotide
gcctccctcgcgccatcaggtctcctagtagttcgccagccacacagacccccgggctgagacccaggcagggaggggtgacgttcccagggagacggtggccgggctgccctggccccagtgctccaagcacttgtcgacgtctcctagtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgtctcctagtagttcgctgagcgggctggcaaggc

SEQ ID NO: 2777 - DNA, 495 bp, Artificial Sequence
  Oligonucleotide
gcctccctcgcgccatcaggtctcctacgaactacccagccacacagacccccgggctgagacccaggcagggaggggtgacgttcccagggagacggtggccgggctgccctggccccagtgctccaagcacttgtcgacgtctcctacgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgtctcctacgaactacctgagcgggctggcaaggc

SEQ ID NO: 2778 - DNA, 495 bp, Artificial Sequence
  Oligonucleotide
gcctccctcgcgccatcaggtctcctattaacgtcccagccacacagacccccgggctgagacccaggcagggaggggtgacgttcccagggagacggtggccgggctgccctggccccagtgctccaagcacttgtcgacgtctcctattaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgtctcctattaacgtcctgagcgggctggcaaggc

SEQ ID NO: 2779 - DNA, 495 bp, Artificial Sequence
  Oligonucleotide
gcctccctcgcgccatcaggtctcctaagcaacctccagccacacagacccccgggctgagacccaggcagggaggggtgacgttcccagggagacggtggccgggctgccctggccccagtgctccaagcacttgtcgacgtctcctaagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgtctcctaagcaacctctgagcgggctggcaaggc

SEQ ID NO: 2780 - DNA, 495 bp, Artificial Sequence
  Oligonucleotide
gcctccctcgcgccatcaggtctcctattctcgagccagccacacagacccccgggctgagacccaggcagggaggggtgacgttcccagggagacggtggccgggctgccctggccccagtgctccaagcacttgtcgacgtctcctattctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgtctcctattctcgagctgagcgggctggcaaggc

SEQ ID NO: 2781 - DNA, 495 bp, Artificial Sequence
  Oligonucleotide
gcctccctcgcgccatcaggtctcctaactctacgccagccacacagacccccgggctgagacccaggcagggaggggtgacgttcccagggagacggtggccgggctgccctggccccagtgctccaagcacttgtcgacgtctcctaactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgtctcctaactctacgctgagcgggctggcaaggc

SEQ ID NO: 2782 - DNA, 495 bp, Artificial Sequence
  Oligonucleotide
gcctccctcgcgccatcaggtctcctataccggaaccagccacacagacccccgggctgagacccaggcagggaggggtgacgttcccagggagacggtggccgggctgccctggccccagtgctccaagcacttgtcgacgtctcctataccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgtctcctataccggaactgagcgggctggcaaggc

SEQ ID NO: 2783 - DNA, 495 bp, Artificial Sequence
  Oligonucleotide
gcctccctcgcgccatcaggtctcctacgaattgcccagccacacagacccccgggctgagacccaggcagggaggggtgacgttcccagggagacggtggccgggctgccctggccccagtgctccaagcacttgtcgacgtctcctacgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgtctcctacgaattgcctgagcgggctggcaaggc

SEQ ID NO: 2784 - DNA, 495 bp, Artificial Sequence
  Oligonucleotide
gcctccctcgcgccatcaggtctcctattcgctcaccagccacacagacccccgggctgagacccaggcagggaggggtgacgttcccagggagacggtggccgggctgccctggccccagtgctccaagcacttgtcgacgtctcctattcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagtctcctattcgctcactgagcgggctggcaaggc

SEQ ID NO: 2785 - DNA, 495 bp, Artificial Sequence
  Oligonucleotide
gcctccctcgcgccatcaggtctcctagacgttaaccagccacacagacccccgggctgagacccaggcagggaggggtgacgttcccagggagacggtggccgggctgccctggccccagtgctccaagcacttgtcgacgtctcctagacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggtctcctagacgttaactgagcgggctggcaaggc

SEQ ID NO: 2786 - DNA, 495 bp, Artificial Sequence
  Oligonucleotide
gcctccctcgcgccatcaggtctcctacgtagagtccagccacacagacccccgggctgagacccaggcagggaggggtgacgttcccagggagacggtggccgggctgccctggccccagtgctccaagcacttgtcgacgtctcctacgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgtctcctacgtagagtctgagcgggctggcaaggc

SEQ ID NO: 2787 - DNA, 495 bp, Artificial Sequence
  Oligonucleotide
gcctccctcgcgccatcaggtctcctattccggtaccagccacacagacccccgggctgagacccaggcagggaggggtgacgttcccagggagacggtggccgggctgccctggccccagtgctccaagcacttgtcgacgtctcctattccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgtctcctattccggtactgagcgggctggcaaggc

SEQ ID NO: 2788 - DNA, 495 bp, Artificial Sequence
  Oligonucleotide
gcctccctcgcgccatcaggtctcctagcaattcgccagccacacagacccccgggctgagacccaggcagggaggggtgacgttcccagggagacggtggccgggctgccctggccccagtgctccaagcacttgtcgacgtctcctagcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgtctcctagcaattcgctgagcgggctggcaaggc

SEQ ID NO: 2789 - DNA, 495 bp, Artificial Sequence
  Oligonucleotide
gcctccctcgcgccatcaggtctcctatgagcgaaccagccacacagacccccgggctgagacccaggcagggaggggtgacgttcccagggagacggtggccgggctgccctggccccagtgctccaagcacttgtcgacgtctcctatgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgtctcctatgagcgaactgagcgggctggcaaggc

SEQ ID NO: 2790 - DNA, 495 bp, Artificial Sequence
  Oligonucleotide
gcctccctcgcgccatcaggtctcctatactaagcccagccacacagacccccgggctgagacccaggcagggaggggtgacgttcccagggagacggtggccgggctgccctggccccagtgctccaagcacttgtcgacgtctcctatactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgtctcctatactaagcctgagcgggctggcaaggc

SEQ ID NO: 2791 - DNA, 495 bp, Artificial Sequence
  Oligonucleotide
gcctccctcgcgccatcaggtctcctatggcgtatccagccacacagacccccgggctgagacccaggcagggaggggtgacgttcccagggagacggtggccgggctgccctggccccagtgctccaagcacttgtcgacgtctcctatggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgtctcctatggcgtatctgagcgggctggcaaggc

SEQ ID NO: 2792 - DNA, 495 bp, Artificial Sequence
  Oligonucleotide
gcctccctcgcgccatcaggtctcctagataaccaccagccacacagacccccgggctgagacccaggcagggaggggtgacgttcccagggagacggtggccgggctgccctggccccagtgctccaagcacttgtcgacgtctcctagataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggtctcctagataaccactgagcgggctggcaaggc

SEQ ID NO: 2793 - DNA, 495 bp, Artificial Sequence
  Oligonucleotide
gcctccctcgcgccatcaggtctcctactagtgaaccagccacacagacccccgggctgagacccaggcagggaggggtgacgttcccagggagacggtggccgggctgccctggccccagtgctccaagcacttgtcgacgtctcctactagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggtctcctactagtgaactgagcgggctggcaaggc

SEQ ID NO: 2794 - DNA, 495 bp, Artificial Sequence
  Oligonucleotide
gcctccctcgcgccatcaggtctcctaacgttcacccagccacacagacccccgggctgagacccaggcagggaggggtgacgttcccagggagacggtggccgggctgccctggccccagtgctccaagcacttgtcgacgtctcctaacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgtctcctaacgttcacctgagcgggctggcaaggc

SEQ ID NO: 2795 - DNA, 448 bp, Artificial Sequence
  Oligonucleotide
gcctccctcgcgccatcaggtctcctaattacgctccagccacacagacccccgggctgagacccaggcagggaggggtgacgttcccagggagacggtggccgggctgccctggccccagtgctccaagcacttgtcgacgtctcctaattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagtctcctaattacgctctgagcgggctggcaaggc

SEQ ID NO: 2796 - DNA, 495 bp, Artificial Sequence
  Oligonucleotide
gcctccctcgcgccatcaggtctcctacattgagtccagccacacagacccccgggctgagacccaggcagggaggggtgacgttcccagggagacggtggccgggctgccctggccccagtgctccaagcacttgtcgacgtctcctacattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgtctcctacattgagtctgagcgggctggcaaggc

SEQ ID NO: 2797 - DNA, 495 bp, Artificial Sequence
  Oligonucleotide
gcctccctcgcgccatcaggtagacaccttggttacctgcccttctcatggaaccctctgctggcctcccacgtaccccacattctggcctgacccctcagaagccagaccactgtcggcctgggaagtccaactgtcgacgtagacaccttggttatcaacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctccgtagacaccttggttactgagcgggctggcaaggc

SEQ ID NO: 2798 - DNA, 495 bp, Artificial Sequence
  Oligonucleotide
gcctccctcgcgccatcaggtagacacacctcttgcctgcccttctcatggaaccctctgctggcctcccacgtaccccacattctggcctgacccctcagaagccagaccactgtcggcctgggaagtccaactgtcgacgtagacacacctcttgtcaacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacaccgtagacacacctcttgctgagcgggctggcaaggc

SEQ ID NO: 2799 - DNA, 495 bp, Artificial Sequence
  Oligonucleotide
gcctccctcgcgccatcaggtagacacctgattctcctgcccttctcatggaaccctctgctggcctcccacgtaccccacattctggcctgacccctcagaagccagaccactgtcggcctgggaagtccaactgtcgacgtagacacctgattcttcaacagtaatacacggccgtgtcctcagatctcaggctgctcagctccatgtaggctgtgcttatggaggtgttcctggtcatggtgactctgccctggaacttctgtgcatagcctgtgttaccactgttagggttcatccatcccatccactcaagcccttgtccagtggcctgtcgcacccagttgatatcataactggtgaaggtgtatccagaagccttgcaggagaccttcactgaggccccaggcttcttcacctcagccccagactgcaccagctgcacctgggagtgggcaccgtagacacctgattctctgagcgggctggcaaggc

SEQ ID NO: 2800 - DNA, 495 bp, Artificial Sequence
  Oligonucleotide
gcctccctcgcgccatcaggtagacacagtaccgacctgcccttctcatggaaccctctgctggcctcccacgtaccccacattctggcctgacccctcagaagccagaccactgtcggcctgggaagtccaactgtcgacgtagacacagtaccgatcaacagtaatacacggccgtgtcgtcagatctcaggctcctcagctccatgtaggctgtgctcgtggatgtgtctgtggtcatggtgactctgccctggagcttctgtgcatagtttgtgttaccattgtaagcgctgatccatcccatccactcaagcccttgtccaggggcctgtcgcacccagctgataccatagctggtaaaggtgtaaccagaagccttgcaggagaccttcactgaggccccaggcttcttcacctcagctccagactgcaccagctgaacctgggagtgggcaccgtagacacagtaccgactgagcgggctggcaaggc

SEQ ID NO: 2801 - DNA, 495 bp, Artificial Sequence
  Oligonucleotide
gcctccctcgcgccatcaggtagacacatccatggcctgcccttctcatggaaccctctgctggcctcccacgtaccccacattctggcctgacccctcagaagccagaccactgtcggcctgggaagtccaactgtcgacgtagacacatccatggtcaacagtaatacacggccgtgtcctcagatctcaggctgctcagctccatgtaggctgtgtctgtagatgtgtcctcggtcatggtgactctgccctggaacttctgtgcgtagattgtttcaccatcttcaggatcaaaacctcccatccactcaagcccttttccaggagcctgtcgcacccagtgcatggataattcagtgagggtgtatccggaaaccttgcaggagaccttcactgaggccccaggcttcttcacctcagccccagactgtaccagctggacctgggcgtgggtgccgtagacacatccatggctgagcgggctggcaaggc

SEQ ID NO: 2802 - DNA, 495 bp, Artificial Sequence
  Oligonucleotide
gcctccctcgcgccatcaggtagacacgtagcagtcctgcccttctcatggaaccctctgctggcctcccacgtaccccacattctggcctgacccctcagaagccagaccactgtcggcctgggaagtccaactgtcgacgtagacacgtagcagttcaacagtaatacatggctgtgtcctcagatctcaggctgctcagctccatgtaggctgtgctcatagacctgtccctggtaatggtgactctgtcctggaatttctgtgcgtagttggtgttaccattgaaaggtgtgatccatcccatccactcaagcgcttgtccgggggcctgtcgcacccagtgcaggtagcggtaggtgaaggtgtatccggaagccttgcaggaaaccttcactgaggacccagtcttcttcacctcagccccagactgcaccagctgcatctgggagtaggcatcgtagacacgtagcagtctgagcgggctggcaaggc

SEQ ID NO: 2803 - DNA, 495 bp, Artificial Sequence
  Oligonucleotide
gcctccctcgcgccatcaggtagacacatcttcgtcctgcccttctcatggaaccctctgctggcctcccacgtaccccacattctggcctgacccctcagaagccagaccactgtcggcctgggaagtccaactgtcgacgtagacacatcttcgttcaacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcaccgtagacacatcttcgtctgagcgggctggcaaggc

SEQ ID NO: 2804 - DNA, 495 bp, Artificial Sequence
  Oligonucleotide
gcctccctcgcgccatcaggtagacactccacagtcctgcccttctcatggaaccctctgctggcctcccacgtaccccacattctggcctgacccctcagaagccagaccactgtcggcctgggaagtccaactgtcgacgtagacactccacagttcaacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcaccagctgcatttgggagtgggcaccgtagacactccacagtctgagcgggctggcaaggc

SEQ ID NO: 2805 - DNA, 495 bp, Artificial Sequence
  Oligonucleotide
gcctccctcgcgccatcaggtagacacagctagtgcctgcccttctcatggaaccctctgctggcctcccacgtaccccacattctggcctgacccctcagaagccagaccactgtcggcctgggaagtccaactgtcgacgtagacacagctagtgtcaacagtaatacacggccgtgtcctcagatctcaggctgctcagctccatgtaggctgtgctcgtggatttgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctgcacctgggactggacaccgtagacacagctagtgctgagcgggctggcaaggc

SEQ ID NO: 2806 - DNA, 495 bp, Artificial Sequence
  Oligonucleotide
gcctccctcgcgccatcaggtagacactaaccaagcctgcccttctcatggaaccctctgctggcctcccacgtaccccacattctggcctgacccctcagaagccagaccactgtcggcctgggaagtccaactgtcgacgtagacactaaccaagtcaatagtaatacacagccatgtcctcagatgtcaggctgctcaggtctgtgtaggctgtggttgtggacatgtccctggtcatggtgaatctgccctgaaacttcttggcatagcttgggctaccattgccagggttgatccatcccatccactcaagcccttgtccaggggactgttgcacccaatgtataccgtagctggtgatggtaaacccagaaaaactacaggagactttcactgaggccccagacttcctcacctcagcccaagactgcaccagctggacctgggagtgggcaccgtagacactaaccaagctgagcgggctggcaaggc

SEQ ID NO: 2807 - DNA, 495 bp, Artificial Sequence
  Oligonucleotide
gcctccctcgcgccatcaggtagacaccaagaggtcctgcccttctcatggaaccctctgctggcctcccacgtaccccacattctggcctgacccctcagaagccagaccactgtcggcctgggaagtccaactgtcgacgtagacaccaagaggttcaacagtaatacacggccgtgtcctcagatctcaggctgctcagctccatgtaggctgtgtctgtagacgtgtccgcggttatggtgactctgccctggaacttctctgcgtatattgtttcaccatcttcaggatcaacaagtcccatccactcaagcccttttccaggggcctgttgcacccagtgcatgtagtagtcggtgaaggtgtatccagaaaccttgcaggagattttcactgtagccccaggcttcttcacctcagccccagactgtaccagctggacctcggcgtgggtgccgtagacaccaagaggtctgagcgggctggcaaggc

SEQ ID NO: 2808 - DNA, 495 bp, Artificial Sequence
  Oligonucleotide
gcctccctcgcgccatcaggtagacacagttgacccctgcccttctcatggaaccctctgctggcctcccacgtaccccacattctggcctgacccctcagaagccagaccactgtcggcctgggaagtccaactgtcgacgtagacacagttgacctcatgcacagtaatatgtggctgtgtccacagggtccatgttggtcattgtaaggaccacctggtttttggaggtgtccttggtgatggtgagcctgctcttcagagatgggctgtagcgcttatcatcattccaataaatgagtgcaagccactccagggcctttcctgggggctgacggatccagcccacacccactccactagtgctgagtgagaacccagagaaggtgcaggtcagcgtgagggtctgtgtgggtttcaccagcgtaggaccagactccttcaaggtgatctgggacaagtagacacagttgaccctgagcgggctggcaaggc

SEQ ID NO: 2809 - DNA, 495 bp, Artificial Sequence
  Oligonucleotide
gcctccctcgcgccatcaggtagacaccagcatatcctgcccttctcatggaaccctctgctggcctcccacgtaccccacattctggcctgacccctcagaagccagaccactgtcggcctgggaagtccaactgtcgacgtagacaccagcatattcatgcacagtaatatgtggctgtgtccacagggtccatgttggtcatggtaaggaccacctggcttttggaggtgtccttggagatggtgagcctgctcttcagagatgtgctgtaggatttttcgtcattcgaaaaaatgtgtgcaagccactccagggccttccctgggggctgacggatccagctcacacccattctagcattgctgagtgagaacccagagacggtgcaggtcagcgtgagggtctctgtgggtttcaccagcacaggaccagactccttcaaggtgacctgggacaagtagacaccagcatatctgagcgggctggcaaggc

SEQ ID NO: 2810 - DNA, 495 bp, Artificial Sequence
  Oligonucleotide
gcctccctcgcgccatcaggtagacacgcaggattcctgcccttctcatggaaccctctgctggcctcccacgtaccccacattctggcctgacccctcagaagccagaccactgtcggcctgggaagtccaactgtcgacgtagacacgcaggatttcatgcacaataatacgtggctgtgtccacagggtccatgttggtcattgtaaggaccacctggtttttggaggtgtccttggagatggtgagcctggtcttcagagatgtgctgtagtatttatcatcatcccaatcaatgagtgcaagccactccagggccttccctgggggctgacggatccagctcacacacattccactagtgctgagtgagaacccagagaaggtgcaggtcagtgtgagggtctgtgtgggtttcaccagcgcaggaccagactccctcaaggtgacctgggataagtagacacgcaggattctgagcgggctggcaaggc

SEQ ID NO: 2811 - DNA, 495 bp, Artificial Sequence
  Oligonucleotide
gcctccctcgcgccatcaggtagacacgtccattccctgcccttctcatggaaccctctgctggcctcccacgtaccccacattctggcctgacccctcagaagccagaccactgtcggcctgggaagtccaactgtcgacgtagacacgtccattctcaacagtaatacacagccgtgtcctcggctctcaggctgttcatttgcagatacagtgagttcttggcgttgtctctggagatggtgaatcggcccttcacagagtccacatagtatttctcacttccatcttgctttatgttggccacccactccagccccttccctggagcctggcggacccagctcatccaatagctactaaaggtgaatccagaggctgcacaggagagtctcagggaccccccaggctggaccaagcctcccccagactccaccagctgcacctcacactggacaccgtagacacgtccattcctgagcgggctggcaaggc

SEQ ID NO: 2812 - DNA, 495 bp, Artificial Sequence
  Oligonucleotide
gcctccctcgcgccatcaggtagacacgcataactcctgcccttctcatggaaccctctgctggcctcccacgtaccccacattctggcctgacccctcagaagccagaccactgtcggcctgggaagtccaactgtcgacgtagacacgcataacttcatgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcacttcacactggacgtagacacgcataactctgagcgggctggcaaggc

SEQ ID NO: 2813 - DNA, 495 bp, Artificial Sequence
  Oligonucleotide
gcctccctcgcgccatcaggtagacacatatgctgcctgcccttctcatggaaccctctgctggcctcccacgtaccccacattctggcctgacccctcagaagccagaccactgtcggcctgggaagtccaactgtcgacgtagacacatatgctgtcaacagtaatacacggccgtgtcctcggctctcaggctgttcatttgcagatacagtgagttcttggcgttgtccctggagatggtgaatcggcccttcacagagtctgcgtagtatatggtactaccactactactaatgtatgaaacccactccagccccttccctggagcctggcggatccagctcatgtagtagtcactgaaggtgaatccagaggctgcacaggagagtctcagggaccctccaggcttgaccaagcctcccccagactccaccagctgcacctgacactggacaccgtagacacatatgctgctgagcgggctggcaaggc

SEQ ID NO: 2814 - DNA, 495 bp, Artificial Sequence
  Oligonucleotide
gcctccctcgcgccatcaggtagacacaatcctgccctgcccttctcatggaaccctctgctggcctcccacgtaccccacattctggcctgacccctcagaagccagaccactgtcggcctgggaagtccaactgtcgacgtagacacaatcctgctcaacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagctgcacctcacactggacacctgcgtagacacaatcctgcctgagcgggctggcaaggc

SEQ ID NO: 2815 - DNA, 495 bp, Artificial Sequence
  Oligonucleotide
gcctccctcgcgccatcaggtagacactgagacctcctgcccttctcatggaaccctctgctggcctcccacgtaccccacattctggcctgacccctcagaagccagaccactgtcggcctgggaagtccaactgtcgacgtagacactgagaccttcaacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccaccagctgcacctcacactggtagacactgagacctctgagcgggctggcaaggc

SEQ ID NO: 2816 - DNA, 495 bp, Artificial Sequence
  Oligonucleotide
gcctccctcgcgccatcaggtagacacgaatggaccctgcccttctcatggaaccctctgctggcctcccacgtaccccacattctggcctgacccctcagaagccagaccactgtcggcctgggaagtccaactgtcgacgtagacacgaatggactcaacagtaatacacagccatgtcctcggctctccgtctgttcttttgcagatacagggagttcctggaattgtctctggagatgatgaatcggcgcttcacggagtccacatagtgcgtcctactgccattccaactaacacccgatacccactccagcccctttcctggagccttgcgggcccagttcatgtcactgttactgaaggtgaatccagaggctgcacaggagagtctcagggaccccccaggctgtaccaagcctcccccagactccaccagctgcacctcacactggacaccgtagacacgaatggacctgagcgggctggcaaggc

SEQ ID NO: 2817 - DNA, 495 bp, Artificial Sequence
  Oligonucleotide
gcctccctcgcgccatcaggtagacaccacatggacctgcccttctcatggaaccctctgctggcctcccacgtaccccacattctggcctgacccctcagaagccagaccactgtcggcctgggaagtccaactgtcgacgtagacaccacatggatcaacagtgatacaaggccgtgtcctcggctctcagactgttcatttgcagatacagggagttcttggcgttgtctctggagatggtgaatcggcccttcacagagtctgcataacctgtgctaccaccattccaattaataccagagacccactccagccccttccctggagcttggcggacccagctcatgccataatcatcaaaggtgaatccagaggctgcacaggagagtctcagggaccccccaggccgtaccacacctcccccagactccaccagctgcacctcacactggacaccgtagacaccacatggactgagcgggctggcaaggc

SEQ ID NO: 2818 - DNA, 495 bp, Artificial Sequence
  Oligonucleotide
gcctccctcgcgccatcaggtagacacttgaccatcctgcccttctcatggaaccctctgctggcctcccacgtaccccacattctggcctgacccctcagaagccagaccactgtcggcctgggaagtccaactgtcgacgtagacacttgaccattcaacagtaatacacagccgtgtcctcggctctcaggctgttcatttgcagatacagtgagttcttggcgttgtctctggagatggtgaatcggcccttcactgagtctgcgtagtatatgtaactactactactactaatggatgagacccactccagccccttccctggagcctggcggacccagttcatgctatagctactgaaggtgaatccagaggctgcacaggagagtctcagggaccccccaggcttgaccaggcctcccccagactccaccagctgcacctcacactggacaccgtagacacttgaccatctgagcgggctggcaaggc

SEQ ID NO: 2819 - DNA, 495 bp, Artificial Sequence
  Oligonucleotide
gcctccctcgcgccatcaggtagacacaagccatccctgcccttctcatggaaccctctgctggcctcccacgtaccccacattctggcctgacccctcagaagccagaccactgtcggcctgggaagtccaactgtcgacgtagacacaagccatctcaacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaacagctgcacctcacactggacaccgtagacacaagccatcctgagcgggctggcaaggc

SEQ ID NO: 2820 - DNA, 495 bp, Artificial Sequence
  Oligonucleotide
gcctccctcgcgccatcaggtagacactccatgtgcctgcccttctcatggaaccctctgctggcctcccacgtaccccacattctggcctgacccctcagaagccagaccactgtcggcctgggaagtccaactgtcgacgtagacactccatgtgtcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtagacactccatgtgctgagcgggctggcaaggc

SEQ ID NO: 2821 - DNA, 495 bp, Artificial Sequence
  Oligonucleotide
gcctccctcgcgccatcaggtagacaccaagtcaccctgcccttctcatggaaccctctgctggcctcccacgtaccccacattctggcctgacccctcagaagccagaccactgtcggcctgggaagtccaactgtcgacgtagacaccaagtcactcaacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacaccgtagacaccaagtcacctgagcgggctggcaaggc

SEQ ID NO: 2822 - DNA, 495 bp, Artificial Sequence
  Oligonucleotide
gcctccctcgcgccatcaggtagacacctgcaatccctgcccttctcatggaaccctctgctggcctcccacgtaccccacattctggcctgacccctcagaagccagaccactgtcggcctgggaagtccaactgtcgacgtagacacctgcaatctcaacagtaatacacagccgtgtcctcggctctcaggctgttcatttgcagatacagcgtgttcttggaattgtctctggagatggtgaatcggcccttcacggagtctgcatagtatttattacttccatcataccatataactgccacccactccagccccttgcctggagcctggcggacccagtgcatgccatagctactgaaggtgaatccagacgctgcacaggagagtctcagggacctcccaggctggaccacgcctcccccagactccaccagctgcacctgacactggacaccgtagacacctgcaatcctgagcgggctggcaaggc

SEQ ID NO: 2823 - DNA, 495 bp, Artificial Sequence
  Oligonucleotide
gcctccctcgcgccatcaggtagacacatcgacgacctgcccttctcatggaaccctctgctggcctcccacgtaccccacattctggcctgacccctcagaagccagaccactgtcggcctgggaagtccaactgtcgacgtagacacatcgacgatcaacagtaatacacagccgtgtcctcggccctcaggctattcgtttgcagatacagggtgttcctggaattgtctctggagatgatgaatcggcccttcacagagtctgcatagtgcgtcctactgccattccaactaacacccgatacccactccagcccctttcctggagcctgatggacccagttcatgtcactgttactgaaggtgaatccagaggctgcacaggagagtctcagggatcccccaggctgtaccaagcctcccccagactccaccagctgcacctcacactggacaccgtagacacatcgacgactgagcgggctggcaaggc

SEQ ID NO: 2824 - DNA, 495 bp, Artificial Sequence
  Oligonucleotide
gcctccctcgcgccatcaggtagacacacagactgcctgcccttctcatggaaccctctgctggcctcccacgtaccccacattctggcctgacccctcagaagccagaccactgtcggcctgggaagtccaactgtcgacgtagacacacagactgtcaacagtaatacacggccgtgccctcagctctcaggttgttcatttgaagatacagcgtgttcttggaattgtctctggagatggtgaatctgcccttcctggagtctgcgtagtatgtgctaccaccactaatggatgagacccactccagccccttccctggagcctggcggatccagctcatctcattgctactgacggtgaatccagaggctgcacaggagagtctcagggaccccctaggctgtaccaagcctcccccagactccaccagctgcacctcacactggacacctgcaaagtagacacacagactgctgagcgggctggcaaggc

SEQ ID NO: 2825 - DNA, 495 bp, Artificial Sequence
  Oligonucleotide
gcctccctcgcgccatcaggtagacacccttatagcctgcccttctcatggaaccctctgctggcctcccacgtaccccacattctggcctgacccctcagaagccagaccactgtcggcctgggaagtccaactgtcgacgtagacacccttatagtcatgcacagtaatacaaggcggtgtcctcagttctcagactgttcatttgcagatacagggagtttttgctgttgtctctggagatggtgaatcggcccttcacagagtctgcatagtatgtgctaccaccatcccaactaataagagagacccactccagacccttccccggagcttgacggacccagtgcatggtataatcatcaaaggtgaatccagaggctgcacaggagagtctcagggaccccccaggctgtaccacgactcccccagactccaccagctgcacttcacactggacgtagacacccttatagctgagcgggctggcaaggc

SEQ ID NO: 2826 - DNA, 495 bp, Artificial Sequence
  Oligonucleotide
gcctccctcgcgccatcaggtagacactacgcgttcctgcccttctcatggaaccctctgctggcctcccacgtaccccacattctggcctgacccctcagaagccagaccactgtcggcctgggaagtccaactgtcgacgtagacactacgcgtttcaacagtaatacacagccgtgtcctcgtctctcaggctgttcatttgcagatacagtgagttcttggcattgtctctggagatggtgaatcggcccttcacagagtctgcgtagtatatggtactactactactactaatgtatgaaacccactccagccccttccctggagcctggcggacccagttcatgctatagctactgaaggtgaatccagaggctgcacaggagagtctcagggaccccccaggctgtaccaagcctcccccagactccaccagctgcacctcacactggacaccgtagacactacgcgttctgagcgggctggcaaggc

SEQ ID NO: 2827 - DNA, 495 bp, Artificial Sequence
  Oligonucleotide
gcctccctcgcgccatcaggtagacacctataaggcctgcccttctcatggaaccctctgctggcctcccacgtaccccacattctggcctgacccctcagaagccagaccactgtcggcctgggaagtccaactgtcgacgtagacacctataaggtcaacagtaatacacggctgtgtcctcggttttcaggctgttcatttgcagataggcgatgcttttggaatcatctcttgagatggtgaatctgcctttcacagacgcggcgtattctgttgtcccaccataagctttgcttctaatgaaacctacccactccagccccttccctggagcctggcggaaccagctcatagcataatcaccaaaggtgaatccagaagctgtacaggagagtctcagggaccgccctggctgtaccaagcctcccccagactccaccagctgcacctcacattggtagacacctataaggctgagcgggctggcaaggc

SEQ ID NO: 2828 - DNA, 495 bp, Artificial Sequence
  Oligonucleotide
gcctccctcgcgccatcaggtagacactcttagtccctgcccttctcatggaaccctctgctggcctcccacgtaccccacattctggcctgacccctcagaagccagaccactgtcggcctgggaagtccaactgtcgacgtagacactcttagtctcaacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtagacactcttagtcctgagcgggctggcaaggc

SEQ ID NO: 2829 - DNA, 495 bp, Artificial Sequence
  Oligonucleotide
gcctccctcgcgccatcaggtagacactgtctgcacctgcccttctcatggaaccctctgctggcctcccacgtaccccacattctggcctgacccctcagaagccagaccactgtcggcctgggaagtccaactgtcgacgtagacactgtctgcatcaacagtaatacacagccatgtcctcagctctcaggctgcccatttgaagatacagcgtgttcttggaattgtctctggagatggtgaatctgcccttcacagagtctgcataatatgtgctacccccattactactaatagctgaaacatattccagtcccttccctggagcctggcggacccagtgcatagcatagctactgaaggtgaatccagaggctgcacaggagagtctcagggaccccccaggctggaccaagccttccccagactccaccagctgcacctcacactggacaccgtagacactgtctgcactgagcgggctggcaaggc

SEQ ID NO: 2830 - DNA, 495 bp, Artificial Sequence
  Oligonucleotide
gcctccctcgcgccatcaggtagacacgccattaacctgcccttctcatggaaccctctgctggcctcccacgtaccccacattctggcctgacccctcagaagccagaccactgtcggcctgggaagtccaactgtcgacgtagacacgccattaatcaacagtaatacacagccgtgtcctcagctctcaggctgttcatttgaagatacagcgtgttcttggaattgtctctggagatggtgaatcggcccttcacggagtctgcgtagtatgtgctaccacagctataaataactgagacccactccagccccttccctggagcctggcggacccagctcatgtagttgctactgacggtgaacccagaggctgcacaggagagtctcagggaccccccaggctggatcaagcctcctccagactccaccagctgcacctcacactggacacctgcgtagacacgccattaactgagcgggctggcaaggc

SEQ ID NO: 2831 - DNA, 495 bp, Artificial Sequence
  Oligonucleotide
gcctccctcgcgccatcaggtagacacgactaagacctgcccttctcatggaaccctctgctggcctcccacgtaccccacattctggcctgacccctcagaagccagaccactgtcggcctgggaagtccaactgtcgacgtagacacgactaagatcaacagtaatacacggccgtgtcctcggttttcaggctgttcatttgcagatacagtgagttctttgaatcatctcttgagatggtgaatctgcctttcacagacgcggcgtattctgtggtgtaactgttagctttgtttctagtacggccaacccactccagccccttccctggagcctggcggacccagtccatgtagtggtcactgaaggtgaatccagaggctgcacaggagagtctcagggaccctccaggctggaccaagcctcccccagactccaccagctgcacctcacactggtagacacgactaagactgagcgggctggcaaggc

SEQ ID NO: 2832 - DNA, 495 bp, Artificial Sequence
  Oligonucleotide
gcctccctcgcgccatcaggtagacacaggttgctcctgcccttctcatggaaccctctgctggcctcccacgtaccccacattctggcctgacccctcagaagccagaccactgtcggcctgggaagtccaactgtcgacgtagacacaggttgcttcaacagtaatacacggccgtgtcctcggttttcaggctgttcatttgcagatacgccgtgttctttgaatcatctctggagatggtgaacctgcctttcaccgacgcagcatatgctgtcgcgtaactgttagctttgcttctaatacggccaacccactccagccctttcccggaagcctggcggacccagtgcatagcagagccactgaaggtgaacccagaggctgcacaggagagtttcagggaccccccaggctggaccaagcctcccccggactccaccagctgcacctcacactggtagacacaggttgctctgagcgggctggcaaggc

SEQ ID NO: 2833 - DNA, 495 bp, Artificial Sequence
  Oligonucleotide
gcctccctcgcgccatcaggtagacacctcgagaacctgcccttctcatggaaccctctgctggcctcccacgtaccccacattctggcctgacccctcagaagccagaccactgtcggcctgggaagtccaactgtcgacgtagacacctcgagaatcaacagtaatacacagccgtgtcctcggctctcagactgttcatttgcagatacagcgtgttcttggcgttgtctctggagatggtgaatcggcccttcacggagtccgcgtagcttgtgctactcccatcactattaatacgtgagacccacaccagccccttccctggagcttggcggacccagtgcatccagtagctactgaaggtgaatccagaggctgcacaggagagtctcagggaccccccaggctgaactaagcctcccccggactccaccagctgcacctcacactggacaccgtagacacctcgagaactgagcgggctggcaaggc

SEQ ID NO: 2834 - DNA, 495 bp, Artificial Sequence
  Oligonucleotide
gcctccctcgcgccatcaggtagacacttaatggccctgcccttctcatggaaccctctgctggcctcccacgtaccccacattctggcctgacccctcagaagccagaccactgtcggcctgggaagtccaactgtcgacgtagacacttaatggctcaacagtaatacacagccgtgtcctcagctctcaggctgttcatttgcagatacagcgtgttcttggaattgtctctggagatggtgaatcggcccttcacggagtctgcatagtatttattacttccatcataccgtataaatgccacccactccagccccttgcctggagcctggcggacccagtgcatgccatagctactgaaggtgaatccagacgctgcacaggagagtctcagggaccccccaggctggaccacgcctcccccagactccaccagctgcacctgacactggacaccgtagacacttaatggcctgagcgggctggcaaggc

SEQ ID NO: 2835 - DNA, 495 bp, Artificial Sequence
  Oligonucleotide
gcctccctcgcgccatcaggtagacactgcagacacctgcccttctcatggaaccctctgctggcctcccacgtaccccacattctggcctgacccctcagaagccagaccactgtcggcctgggaagtccaactgtcgacgtagacactgcagacatcaacagtaatacacagccgtgtcctcagctctcaggctgttcatttgaagatgcagcgtgttcttggaattgtctctggagatggtgaatctgcccttcctggagtctgcgtagtatgtgctaccaccactaatggatgagacccactccagacccttccctggagcctggcggacccagctcatctcattgctactgacggtgaatccagaggctgcacaggagagtctcagggaccccccaggctgtaccaagactccccgagactccaccagctgcacctcacactggacacctgcaaagtagacactgcagacactgagcgggctggcaaggc

SEQ ID NO: 2836 - DNA, 495 bp, Artificial Sequence
  Oligonucleotide
gcctccctcgcgccatcaggtagacactcactgagcctgcccttctcatggaaccctctgctggcctcccacgtaccccacattctggcctgacccctcagaagccagaccactgtcggcctgggaagtccaactgtcgacgtagacactcactgagtcaacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgtagacactcactgagctgagcgggctggcaaggc

SEQ ID NO: 2837 - DNA, 495 bp, Artificial Sequence
  Oligonucleotide
gcctccctcgcgccatcaggtagacacgagtacgtcctgcccttctcatggaaccctctgctggcctcccacgtaccccacattctggcctgacccctcagaagccagaccactgtcggcctgggaagtccaactgtcgacgtagacacgagtacgttcaacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccacgtagacacgagtacgtctgagcgggctggcaaggc

SEQ ID NO: 2838 - DNA, 495 bp, Artificial Sequence
  Oligonucleotide
gcctccctcgcgccatcaggtagacacatacgccacctgcccttctcatggaaccctctgctggcctcccacgtaccccacattctggcctgacccctcagaagccagaccactgtcggcctgggaagtccaactgtcgacgtagacacatacgccatcaacagtaatacacggccgtgtccgcggcggtcacagagctcagcttcagggagaactggttcttggacctgtctactgatatggtgactcgactcttgagggacgggttgtagtaggtgctcccactatgatagatgtacccaatccactccaggcccttccctggtggctgccggatccagctccaggagtaaccaccactgctgatggagccaccagagacagcgcaggtgagggacagggtctgtgaaggcttcaccagtcctgagccggactcctgcagctgcagctgggacaggacgtagacacatacgccactgagcgggctggcaaggc

SEQ ID NO: 2839 - DNA, 495 bp, Artificial Sequence
  Oligonucleotide
gcctccctcgcgccatcaggtagacactcgcatcacctgcccttctcatggaaccctctgctggcctcccacgtaccccacattctggcctgacccctcagaagccagaccactgtcggcctgggaagtccaactgtcgacgtagacactcgcatcatcaacagtaatacacggccgtgtctgcggcagtcacagagctcagcttcagggagaactggttcttggacgtgtctactgatatggtaactcgactcttgagggacgggttgtagtaggtgctcccactgtaatagatgtacccaatccactccaggcccttccctgggggctggcggatccaactccagtagtaatcaccactgctgatggagccaccagagacagtgcaggtgagggacagggtctgtgaaggcttcaccagtcctgggcccgactcctgcagctgcacctgggacaggacgtagacactcgcatcactgagcgggctggcaaggc

SEQ ID NO: 2840 - DNA, 495 bp, Artificial Sequence
  Oligonucleotide
gcctccctcgcgccatcaggtagacaccgcttaatcctgcccttctcatggaaccctctgctggcctcccacgtaccccacattctggcctgacccctcagaagccagaccactgtcggcctgggaagtccaactgtcgacgtagacaccgcttaattcaacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacgtagacaccgcttaatctgagcgggctggcaaggc

SEQ ID NO: 2841 - DNA, 495 bp, Artificial Sequence
  Oligonucleotide
gcctccctcgcgccatcaggtagacactggttatccctgcccttctcatggaaccctctgctggcctcccacgtaccccacattctggcctgacccctcagaagccagaccactgtcggcctgggaagtccaactgtcgacgtagacactggttatctcaacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctgggacaggacccctgtgtagacactggttatcctgagcgggctggcaaggc

SEQ ID NO: 2842 - DNA, 495 bp, Artificial Sequence
  Oligonucleotide
gcctccctcgcgccatcaggtagacacggattgctcctgcccttctcatggaaccctctgctggcctcccacgtaccccacattctggcctgacccctcagaagccagaccactgtcggcctgggaagtccaactgtcgacgtagacacggattgcttcaacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctgggacaggacgtagacacggattgctctgagcgggctggcaaggc

SEQ ID NO: 2843 - DNA, 495 bp, Artificial Sequence
  Oligonucleotide
gcctccctcgcgccatcaggtagacacctcagtgacctgcccttctcatggaaccctctgctggcctcccacgtaccccacattctggcctgacccctcagaagccagaccactgtcggcctgggaagtccaactgtcgacgtagacacctcagtgatcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaactactgatggagccaccagagacagtgcaggtgagggacagggtctccgaaggcttcaccagtcctgggcccgactcctgcagctgcacctgggacaggacccctgtgtagacacctcagtgactgagcgggctggcaaggc

SEQ ID NO: 2844 - DNA, 495 bp, Artificial Sequence
  Oligonucleotide
gcctccctcgcgccatcaggtagacacacgtactccctgcccttctcatggaaccctctgctggcctcccacgtaccccacattctggcctgacccctcagaagccagaccactgtcggcctgggaagtccaactgtcgacgtagacacacgtactctcaacagtaatacacggccgtgtccgcagcggtcacagagctcagcttcagggagaactggttcttggacgtgtctactgatatggtgactcgactcttgagggaggggttgtagttggtgctcccactgtaatagatatacccaatccactccagtcccttccctgggggctgccggatccagctccagtagtaaccaccactgctgacggagccaccagagacagtgcaggtgagggacagggtctccgaaggcttcaccagtcctgggcccgactcctgcagctgcacctgggacaggacgtagacacacgtactcctgagcgggctggcaaggc

SEQ ID NO: 2845 - DNA, 495 bp, Artificial Sequence
  Oligonucleotide
gcctccctcgcgccatcaggtagacactgatgcgacctgcccttctcatggaaccctctgctggcctcccacgtaccccacattctggcctgacccctcagaagccagaccactgtcggcctgggaagtccaactgtcgacgtagacactgatgcgatcaacagtaatacacggccgtgtctgcggcggtcacagagctcagcttcagggagaactggttcttggacgtgtctactgatatggtgactcgactcttgagggacgggttgtagtaggtgctcccactatgatagatactcccaatccactccagccccttccctgggggctgccggatccagccccagtagtaaccactgctgatggagtaaccagagacagcgcaggtgagggacagggtctccgaaggcttcaccagtcctgggcccgactcctgcagctgcacctgggacaggaccccgtagacactgatgcgactgagcgggctggcaaggc

SEQ ID NO: 2846 - DNA, 495 bp, Artificial Sequence
  Oligonucleotide
gcctccctcgcgccatcaggtagacacattaagcgcctgcccttctcatggaaccctctgctggcctcccacgtaccccacattctggcctgacccctcagaagccagaccactgtcggcctgggaagtccaactgtcgacgtagacacattaagcgtcaacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcacctcggcacagactccgtagacacattaagcgctgagcgggctggcaaggc

SEQ ID NO: 2847 - DNA, 495 bp, Artificial Sequence
  Oligonucleotide
gcctccctcgcgccatcaggtagacacagcaatcccctgcccttctcatggaaccctctgctggcctcccacgtaccccacattctggcctgacccctcagaagccagaccactgtcggcctgggaagtccaactgtcgacgtagacacagcaatcctcaacagtaatacatggcggtgtccgaggccttcaggctgctccactgcaggtaggcagtgctgatggacttgtcagctgagatggtgacgtggccttggaaggacgggctgtagttggtataagagtcactaggatcaatcctccccatccactccaagcctttcccgggcatctggcgcacccagctgatccagtagctggtaaagctgtatccagaacccttacaggagatcctcagagactccccgggctttttcacctctgctccagactgcaccagctgcacttcggcacagactccgtagacacagcaatccctgagcgggctggcaaggc

SEQ ID NO: 2848 - DNA, 495 bp, Artificial Sequence
  Oligonucleotide
gcctccctcgcgccatcaggtagacacgcttagtacctgcccttctcatggaaccctctgctggcctcccacgtaccccacattctggcctgacccctcagaagccagaccactgtcggcctgggaagtccaactgtcgacgtagacacgcttagtatcaacagtaatacacagccgtgtcctcgggagtcacagagttcagctgcagggagaactggttcttggatgtgtctgggttgatggttattcgacttttcacagatactgcataatcattataccacttggacctgtagtatgtccttcccagccactcaaggcctctcgatggggactgcctgatccagttccaagcagcactgttgctagagacactgtccccggagatggcacaggtgagtgagagggtctgcgagggcttcaccagtcctggacctgactgctgcagctgtacctgtgagtagacacgcttagtactgagcgggctggcaaggc

SEQ ID NO: 2849 - DNA, 495 bp, Artificial Sequence
  Oligonucleotide
gcctccctcgcgccatcaggtagacactgaccttgcctgcccttctcatggaaccctctgctggcctcccacgtaccccacattctggcctgacccctcagaagccagaccactgtcggcctgggaagtccaactgtcgacgtagacactgaccttgtcaacagtaatacacggcagtgtcctcagcctttaggctgcagatctgcagatatgccgtgctgacagaggtgtccaaggagaagacaaaccgtcctgtgaagccctgggcatacgttgggttcccagtgttggtgttgatccatcccatccactcaagcccttgtccaggggcctgtcgcacccaattcatagcatagctagtgaaggtgtatccagaagccttgcaggaaaccttcactgaggccccaggcttcttcaactcagacccagattgcaccagctgcacctgggagtgggcaccgtagacactgaccttgctgagcgggctggcaaggc

SEQ ID NO: 2850 - DNA, 495 bp, Artificial Sequence
  Oligonucleotide
gcctccctcgcgccatcaggtagacaccaaggtcacctgcccttctcatggaaccctctgctggcctcccacgtaccccacattctggcctgacccctcagaagccagaccactgtcggcctgggaagtccaactgtcgacgtagacaccaaggtcatcaacagtaatacatggccatgtcctcagcctttaggctgctgatctgcaggtatgctgtgctggcagaggtgtccatggagaagacaaaccgtcctgtgaagccctgggcatatgttgggttcccagtgtaggtgttgaaccatcccatccactcaagcccttgtccaggggcctgtggcacccaattcataccataggtggtgaaactgtaaccagaagccttgcaggagaccttcactgaggccccaggctgcttcacctcatggccagactgcaccagctgcacctgggagtaggtaccgtagacaccaaggtcactgagcgggctggcaaggc

SEQ ID NO: 2851 - DNA, 495 bp, Artificial Sequence
  Oligonucleotide
gcctccctcgcgccatcaggtagacaccactgtaccctgcccttctcatggaaccctctgctggcctcccacgtaccccacattctggcctgacccctcagaagccagaccactgtcggcctgggaagtccaactgtcgacgtagacaccactgtactcagggaatgtgcggccctgcccttggccatcacggagctcagctgcagggataactgggccttggatgtgtctctacagatggagagttggcccagaaaggctgggctgaagtgtgtgctgcccctggagctgaggtgccccagcgccttcccagagggctgctgggtccaggcccagaggtctgtgaggacctcaccagccctgggcatgactccagtagctgcatctgatgcaggacactcagggacaagaagcaaagagatgagtcacaagcggacaccacagcccacagcccccgttcgtagacaccactgtacctgagcgggctggcaaggc

SEQ ID NO: 2852 - DNA, 495 bp, Artificial Sequence
  Oligonucleotide
gcctccctcgcgccatcaggtagacacgatgatcccctgcccttctcatggaaccctctgctggcctcccacgtaccccacattctggcctgacccctcagaagccagaccactgtcggcctgggaagtccaactgtcgacgtagacacgatgatcctcagtataaaaatccatggtggtttactcattgtgcgggtagctcagctgtaggaaaaactgttttctgaatgtggatctggaggtggtgactggactcttgagaagcgggttgcactgtgtgtttcctcgtgacctacacacctgacccacttcagcttcttccctgggggctggcagatacagctccaggaggaagtactggttatgattggaaatccagagacagcacaggtgaaggagagggtctctgagggctttactagaacatgagtgcactgaaaaacacaatttttttcatagggtagacacgatgatccctgagcgggctggcaaggc

SEQ ID NO: 2853 - DNA, 495 bp, Artificial Sequence
  Oligonucleotide
gcctccctcgcgccatcaggtagacaccgccaatacctgcccttctcatggaaccctctgctggcctcccacgtaccccacattctggcctgacccctcagaagccagaccactgtcggcctgggaagtccaactgtcgacgtagacaccgccaatatcaataaaaatcatggttgtgtactccttgttaaggtagctcagctgtaggagaaactgttttttggatgtggatctggagatggtgactggactcttgaggagtgggttggattgtgcactccctcatgacctgtgcacctgattcgctccagtcccttccccggggggtgacggatccagctccagcaggaagcactggttgtaatggagaagcagagatgccacaggccagggggaggatctgtgagggcttcaccaggccaggagtgcaccgagaatcacagttgtcggcatgcacagggtagacaccgccaatactgagcgggctggcaaggc

SEQ ID NO: 2854 - DNA, 495 bp, Artificial Sequence
  Oligonucleotide
gcctccctcgcgccatcaggtagacactcaagcctcctgcccttctcatggaaccctctgctggcctcccacgtaccccacattctggcctgacccctcagaagccagaccactgtcggcctgggaagtccaactgtcgacgtagacactcaagccttcacagtaatactcagccgtgtcctaggtggtcatggagctgagcttcacagagaactggctcttggttgagtcactgttgatggggacatggacctgggtggagggtgcatgatgtgtattccttgatgatccagtctagtaactgtgccccagccattccagcctgttgcccacgggatggtggattcatctcaaataatatccatggtaaaaaaaagaatccagacacagcacaggcagagggcagtgtctgagggcctcatgggtcctggacctgactcctgcagctgcacctgggacagtagacactcaagcctctgagcgggctggcaaggc

SEQ ID NO: 2855 - DNA, 495 bp, Artificial Sequence
  Oligonucleotide
gcctccctcgcgccatcaggtagacacacgtgtgtcctgcccttctcatggaaccctctgctggcctcccacgtaccccacattctggcctgacccctcagaagccagaccactgtcggcctgggaagtccaactgtcgacgtagacacacgtgtgttcacttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacaggtagacacacgtgtgtctgagcgggctggcaaggc

SEQ ID NO: 2856 - DNA, 495 bp, Artificial Sequence
  Oligonucleotide
gcctccctcgcgccatcaggtagacactccgtctacctgcccttctcatggaaccctctgctggcctcccacgtaccccacattctggcctgacccctcagaagccagaccactgtcggcctgggaagtccaactgtcgacgtagacactccgtctatcagctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcaggtagacactccgtctactgagcgggctggcaaggc

SEQ ID NO: 2857 - DNA, 495 bp, Artificial Sequence
  Oligonucleotide
gcctccctcgcgccatcaggtagacacaagagctgcctgcccttctcatggaaccctctgctggcctcccacgtaccccacattctggcctgacccctcagaagccagaccactgtcggcctgggaagtccaactgtcgacgtagacacaagagctgtcattcaaaatgtgtagttgtgtgttcactgggcacagagctcagctgtaagaactgtttcttggatctggatatggactcttgagaagtgggatgtaatttttgctccctttacaacccatgaacctgatccactcctgtccatcttctaggggcaagcagatacaattctagcaggacacactggttatgatggggaatccagagacagtgcaggtgagggagagggtctgtgaggatgtctcaagccagaagtgcactggaaaacacagttgttgatgttaacagtttctggacaacacggtagacacaagagctgctgagcgggctggcaaggc

SEQ ID NO: 2858 - DNA, 495 bp, Artificial Sequence
  Oligonucleotide
gcctccctcgcgccatcaggtagacactatcgctccctgcccttctcatggaaccctctgctggcctcccacgtaccccacattctggcctgacccctcagaagccagaccactgtcggcctgggaagtccaactgtcgacgtagacactatcgctctcagctctaaaatacatggctatgtgtttgttgctcacatagttcacctgtaagaagaagtactttttggacatggatctggagatggtgactggactcttgagaagaggggagtaatctgtgctccctccatgacctatgcacccgatccactccagtacctcccatgggggcgctgatggatgcagctccagaaggaaacactggttgtgatggagaatgcagagatggcacaggtgagggagaggttctgtgaaggcttcaccaggccaagagtgcaccgagaaatacagttgttggcaggtagacactatcgctcctgagcgggctggcaaggc

SEQ ID NO: 2859 - DNA, 495 bp, Artificial Sequence
  Oligonucleotide
gcctccctcgcgccatcaggtagacactcagatgccctgcccttctcatggaaccctctgctggcctcccacgtaccccacattctggcctgacccctcagaagccagaccactgtcggcctgggaagtccaactgtcgacgtagacactcagatgctcatgaaagaagaattcatgtgcagacacatctgcttgtctgaagatatagtgcatgtgggaacatgtgggcttgtctgaattcatgataagtgggctggaattcatcctccactcatcacgtatgcacctgacccactcctgtgctttccatccagtgcctacaggaagcactgattgtgacagagaatccagaggcagcacaggtgagtgagggggtttgcaagggcttcaccaggctgataattgactgagaaaaacagttgttagcatgcacaagttctggatgatacattggaaacccgtagacactcagatgcctgagcgggctggcaaggc

SEQ ID NO: 2860 - DNA, 495 bp, Artificial Sequence
  Oligonucleotide
gcctccctcgcgccatcaggtagacacgtgtagcacctgcccttctcatggaaccctctgctggcctcccacgtaccccacattctggcctgacccctcagaagccagaccactgtcggcctgggaagtccaactgtcgacgtagacacgtgtagcatcaacagtaatacaaaccatgtcctcagatgtcacagagctcaggtatagtcaaaattgtttcttggatgaatctctggagaaggagagttggctctgcagagatggatcatcgtgtgtgtcacccttgcaatgtgttcctgacagcccatggaagcgggctagtggattcagctccagcagtaactgttggttgggatggacaacccagaaatggggcatgtgaggaagagaaaatgaaagtggatagcctgttaccgaaaactgctggactaagacacttgtaagcctgtcaatctcagtggtagacacgtgtagcactgagcgggctggcaaggc

SEQ ID NO: 2861 - DNA, 495 bp, Artificial Sequence
  Oligonucleotide
gcctccctcgcgccatcaggtagacactggcagttcctgcccttctcatggaaccctctgctggcctcccacgtaccccacattctggcctgacccctcagaagccagaccactgtcggcctgggaagtccaactgtcgacgtagacactggcagtttcacagccaagatatggaaactaagtgtctgtcaatgggcaaatggataaagacaatgtggtatgtgtacacaacatagcattattatgccttataaaataaggaaatgctgccattttccacaagacaaatggactcccaccaccactagcaatggattttatccattgcagcccctccctgagagccggcagatccaggtccactagtaaggactggttgtgacggagtggccagtaacagtgtaggtgaggcagagggtaagtgtgtgctattcaggtccagggctgactcctgcagctggtagacactggcagttctgagcgggctggcaaggc

SEQ ID NO: 2862 - DNA, 495 bp, Artificial Sequence
  Oligonucleotide
gcctccctcgcgccatcaggtagacaccagtccaacctgcccttctcatggaaccctctgctggcctcccacgtaccccacattctggcctgacccctcagaagccagaccactgtcggcctgggaagtccaactgtcgacgtagacaccagtccaatcagtgtaaaaattcatggttgtgtactcgttgctcaggtagctcagctgtagaagaaactgtgttttggatgtggatctggagatggtgactggactcttgaggcgtgggttgcgttgtgttctccctcatgacctgtgcacctgattcactccagtcccttccctggggagctgagggatccagctccagcaggaagcactggttgtgatggagaagcagagacagcacagatgagggagagggtctgtgagggcttcgccaggccaagaacgcacgagaaatacagatgtcggcatgcacgtagacaccagtccaactgagcgggctggcaaggc

SEQ ID NO: 2863 - DNA, 495 bp, Artificial Sequence
  Oligonucleotide
gcctccctcgcgccatcaggtagacacgtgtctaccctgcccttctcatggaaccctctgctggcctcccacgtaccccacattctggcctgacccctcagaagccagaccactgtcggcctgggaagtccaactgtcgacgtagacacgtgtctactcaagtaatacaaggttgtggcattgttggtcacagaactcagctaaaagaaaatttggttcttggacgtggatctggagatggtgactgagctcatgaggagtgggttagaatttgtgctccctcgtgacctatgccctgatccactcccttgactgaggactggcggatccagctccagcaggaagcactagttgtgatggagaatccagagacagcacaggtgagggagggggtctgtgagggcctcaccaggccaataaatgaccatgaaacacagtggttggtgtgcatggcttctgggtagacacgtgtctacctgagcgggctggcaaggc

SEQ ID NO: 2864 - DNA, 495 bp, Artificial Sequence
  Oligonucleotide
gcctccctcgcgccatcaggtagacacgtacagtgcctgcccttctcatggaaccctctgctggcctcccacgtaccccacattctggcctgacccctcagaagccagaccactgtcggcctgggaagtccaactgtcgacgtagacacgtacagtgtcataaaaatacatggctgtgtgcttgtgactcacttagctcggctgtaggaagaactgctttttggacatggatctggagatggtgactggactcttgaggagtgggttggaatgtgcactccctcatgacctgtgcactggattcactccagtcccttcctggggggtttatgaatgcagctacagcaggaagcactggttgtgatggggaatccagagacagcacaggtgagggagagggtctgtgagggcttcaccaggccaagtgggcactgagaaacacagttgttggcatgcacaggtagacacgtacagtgctgagcgggctggcaaggc

SEQ ID NO: 2865 - DNA, 495 bp, Artificial Sequence
  Oligonucleotide
gcctccctcgcgccatcaggtagacacggatcatccctgcccttctcatggaaccctctgctggcctcccacgtaccccacattctggcctgacccctcagaagccagaccactgtcggcctgggaagtccaactgtcgacgtagacacggatcatctcatttaaaacatggctgtgagcttgttgctcacatagctccactgtaaaaacaagtgttttttggacccgaatttggagatggtgactggattcataaggagtgggtgggaatttttgctcccttcatgacgtgtgcgcctggtccactccagtccttcccatgtggactcgtggatccagctccagcaggaaacactggttgtgatggaaaatccagagacagcacaggtgagggagagggtctgcgagggctccaccaggccaagagtgcactaagaaacacagttgtttgtgagcacaggtagacacggatcatcctgagcgggctggcaaggc

SEQ ID NO: 2866 - DNA, 495 bp, Artificial Sequence
  Oligonucleotide
gcctccctcgcgccatcaggtagacactattggcgcctgcccttctcatggaaccctctgctggcctcccacgtaccccacattctggcctgacccctcagaagccagaccactgtcggcctgggaagtccaactgtcgacgtagacactattggcgtcatgaaaaatatatggctatgtgattgttgctcatgtagctcagctgtaggaagaactgtttttggacatggatctggggatggtgactggactcttgaggaaaggggagtaatgtgtgctcccttcatcatctatggacccaatccactccattccctcccagagagggggtgatggatgcagatccaggaggaagcactggttgtgatggagaatgcagagatgacacacatgagggagagggtctttgggggcttcaccaggccaagagtgcaccgagaaacacagttgttggcaggcagtagacactattggcgctgagcgggctggcaaggc

SEQ ID NO: 2867 - DNA, 495 bp, Artificial Sequence
  Oligonucleotide
gcctccctcgcgccatcaggtagacacaggcttgacctgcccttctcatggaaccctctgctggcctcccacgtaccccacattctggcctgacccctcagaagccagaccactgtcggcctgggaagtccaactgtcgacgtagacacaggcttgatcaattaaaattcatggttgtgtacttgttgctcaggtagctcagctacaggaaacactgttttttggatgtggatctggagatagtgactggactcttgaggagtgggttggaatgtgcactccctcatgacctgtgcacctgattcgctccagtcccttccttgcggggggtgatggatgcagctccagcaggaagcactggttgtgatggagaatgcagagacagcacaggtgagagagagggtctgtgagagcttcactagcccaagagtgcaggagaaacacagttgttggcatgcacgtagacacaggcttgactgagcgggctggcaaggc

SEQ ID NO: 2868 - DNA, 495 bp, Artificial Sequence
  Oligonucleotide
gcctccctcgcgccatcaggtagacacacacacgtcctgcccttctcatggaaccctctgctggcctcccacgtaccccacattctggcctgacccctcagaagccagaccactgtcggcctgggaagtccaactgtcgacgtagacacacacacgttcagcttaaaaatacatggctatgtgcttgttgctcatgtagctcagctgtaggaagaactgcttttttggacacggatctggggatggtgactggacacttgaggagtgggtggtaatgtgtgctcccttcatgacctatgcacccaatccactccattcccttccctggggggctgatggatccagcttcagcaggaagacctcgttatcacggggaacacagacacagcgcaggtaagggagagggtctgtgagggcttcaccaggccaagagtgcgctgagaaacacagttgttggcatgtagacacacacacgtctgagcgggctggcaaggc

SEQ ID NO: 2869 - DNA, 495 bp, Artificial Sequence
  Oligonucleotide
gcctccctcgcgccatcaggtagacactagacggacctgcccttctcatggaaccctctgctggcctcccacgtaccccacattctggcctgacccctcagaagccagaccactgtcggcctgggaagtccaactgtcgacgtagacactagacggatcaagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgagtagacactagacggactgagcgggctggcaaggc

SEQ ID NO: 2870 - DNA, 495 bp, Artificial Sequence
  Oligonucleotide
gcctccctcgcgccatcaggtagacacgagcgatacctgcccttctcatggaaccctctgctggcctcccacgtaccccacattctggcctgacccctcagaagccagaccactgtcggcctgggaagtccaactgtcgacgtagacacgagcgatatcaagtaatacactgcctactcctcagctttccagtagataattttaagggagattgtgatgttaagtgttgtccccaggaactgtgaatcttctttgtgctggagcagagcaccactgagaacttccacttgggtcactcatggctaccacccactccagcccctctcctccagccatcagggcccaataaatgctgcagtcagtgaaggtgaatcttgatgctttgcagaagaagctaagagaatagccaggctattttgccaaagacaaaaatatagatccagtaaacctttgtggttttgtagacacgagcgatactgagcgggctggcaaggc

SEQ ID NO: 2871 - DNA, 495 bp, Artificial Sequence
  Oligonucleotide
gcctccctcgcgccatcaggtagacacgcatctgacctgcccttctcatggaaccctctgctggcctcccacgtaccccacattctggcctgacccctcagaagccagaccactgtcggcctgggaagtccaactgtcgacgtagacacgcatctgatcaagtaatacacggacttttcctgagctctcaggttaatcatcttaaaagagaatctcctgaactgagtgtatttgaggattgttaatcatctttttactcaaggagagtcccactgagaacttctatttgaattattgttattacccacacccacccctgtcatgaagcctgctggatcaagcttatgctgttttcagtgaaagtgaatccagaggctttgcagaaaaggcagaattcctggtctgtagtatttctctgtctaactccattagttaacttcacaggggacttctgaaaacagtagacacgcatctgactgagcgggctggcaaggc

SEQ ID NO: 2872 - DNA, 495 bp, Artificial Sequence
  Oligonucleotide
gcctccctcgcgccatcaggtagacactgctacaccctgcccttctcatggaaccctctgctggcctcccacgtaccccacattctggcctgacccctcagaagccagaccactgtcggcctgggaagtccaactgtcgacgtagacactgctacactcaagtattacaaggccttgtccttgactttcagtttggtccctttaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcatgagagtctcagtgaaccactgggctgtacaattttcccccctgactctatcagtaaatttcacacaggacttctggtagacactgctacacctgagcgggctggcaaggc

SEQ ID NO: 2873 - DNA, 495 bp, Artificial Sequence
  Oligonucleotide
gcctccctcgcgccatcaggtagacacaactgccacctgcccttctcatggaaccctctgctggcctcccacgtaccccacattctggcctgacccctcagaagccagaccactgtcggcctgggaagtccaactgtcgacgtagacacaactgccatcactgtaatatacggccttgcccttggctttcaggttggtccttgtaaggtagactgcacttgaaagggtgtcacttgggaatgttgatttatctgtactcatggagagtaacccttagaactcccatatgatctctcactgttgctacccacaccaattcctgttgtgaagcgtgctggaccaagctcatgctgcacccagtaaacccgaaaccagaggctttgcaggacagtctcagtgaactgctgggctgttaaatttttctccttctgactccatcagtaaacatcacacaggacttgtagacacaactgccactgagcgggctggcaaggc

SEQ ID NO: 2874 - DNA, 495 bp, Artificial Sequence
  Oligonucleotide
gcctccctcgcgccatcaggtagacacttggactgcctgcccttctcatggaaccctctgctggcctcccacgtaccccacattctggcctgacccctcagaagccagaccactgtcggcctgggaagtccaactgtcgacgtagacacttggactgtcaagtaatacacagacttgtcttgggctctcagttttattatcttaaaagagaatcttctgaacagtgtctctgaggactgttaatcttctttgtactgaaggcgagtcccattgagaacttccacttgaattactgttatctccctcaccaacacttgccatgaatcctgctggaccaaacttgttcttttttcagtgaatccaggggctttgcagaacagtctgagaattcttggtctgtagtattttcctgtctgactccactagttaacttcacagaggacttctgcacacacagagggtagacacttggactgctgagcgggctggcaaggc

SEQ ID NO: 2875 - DNA, 495 bp, Artificial Sequence
  Oligonucleotide
gcctccctcgcgccatcaggtagacactcggtactcctgcccttctcatggaaccctctgctggcctcccacgtaccccacattctggcctgacccctcagaagccagaccactgtcggcctgggaagtccaactgtcgacgtagacactcggtacttcacagtaataaacggaattttcctgagctctcaggttaatcatcttaagagagaatcatctgaaaagcgtgtctctgaggactgttaatcttctttgtactcaaggagagtcccactgagaacttccacttgaattactgatgttatcacctacacccacccctgtcatgaagcctgctggaccaagcttatgctgttttcagtgaaagtgaatccacagggtttccagaaaagtctgagaattcttggtctgtagtatttctctgagagactccagtaattaacttcacaggggacctctggtagacactcggtactctgagcgggctggcaaggc

SEQ ID NO: 2876 - DNA, 495 bp, Artificial Sequence
  Oligonucleotide
gcctccctcgcgccatcaggtagacacccatggatcctgcccttctcatggaaccctctgctggcctcccacgtaccccacattctggcctgacccctcagaagccagaccactgtcggcctgggaagtccaactgtcgacgtagacacccatggattcacacagttaaatgctgccatgttctgggttctcaggctgttcatttgcatgtacagcatgtacttggtgttgtctctggaagtggtgagtctgcccctaacatagtctgcattgtattgatgactttcactacgccatataactgcaacccattccagccccttccctgaggcctggcaaacccagtgaatctcatagatactgaaggtgaaccaagaggctgcacaggagagcctcaggggcccctctcagtgtaccaagtctcccccagactctgtaagctgggcctcaccctggatacgtagacacccatggatctgagcgggctggcaaggc

SEQ ID NO: 2877 - DNA, 495 bp, Artificial Sequence
  Oligonucleotide
gcctccctcgcgccatcaggtagacacacgaagatcctgcccttctcatggaaccctctgctggcctcccacgtaccccacattctggcctgacccctcagaagccagaccactgtcggcctgggaagtccaactgtcgacgtagacacacgaagattcacagtaatacactgcctacccctgtgagagccccctcagcttccaagtagattattttaagggagactgtgctggtaattggtgtccctgggaattgtgaatcttcattatgctgatgcagaatatcactgagaacttccacttgaatcaatcactgttaccacccactccagcctctgtcccccagccatctgggctcaatttatgctgtagtcagtgaaggtgaatcttgatgctttgcaaaagaggctaagagaacagccaggctgttttgccaaagataaaaatatagatccagtaagtagacacacgaagatctgagcgggctggcaaggc

SEQ ID NO: 2878 - DNA, 495 bp, Artificial Sequence
  Oligonucleotide
gcctccctcgcgccatcaggtagacacactgtggacctgcccttctcatggaaccctctgctggcctcccacgtaccccacattctggcctgacccctcagaagccagaccactgtcggcctgggaagtccaactgtcgacgtagacacactgtggatcaacagtattacacaaccttgtccttggctttcaggttagtcattgtaaggtagagtgcacgtgaaagggtgtcgctggaccagttaatttatttgtactcatgaagagtaaacctgagcactcccacttgttgactcactgttgccagccaccacaatccctgttgtgaagcctgctggaccaacctcaggctgttgccagaaaaggtgaatccagacgctttgcaagaaagtctcagtgaaccactgggctgtactacgtttacccctctgactccaccactgaacttcatacaggacttgtagacacactgtggactgagcgggctggcaaggc

SEQ ID NO: 2879 - DNA, 495 bp, Artificial Sequence
  Oligonucleotide
gcctccctcgcgccatcaggtagacacggtgtcatcctgcccttctcatggaaccctctgctggcctcccacgtaccccacattctggcctgacccctcagaagccagaccactgtcggcctgggaagtccaactgtcgacgtagacacggtgtcattcaagtaatacatggccttctcctcggctctcaggttggtcattttgagggagactgtgctgacaagggtgtccctgaggattatgatttttctttgtattgatggagggtaccactaacaaattccacttgaatccctcgcttttgcctcccacaccaacccctgtcctgaagcctgctgggctgagctcatgctagagtcaatgaaggtaaattcagaggctttgtaaaaaaggctctgagaacagttaggctgtatcatttctcttccagattccaccagtgaacttcttgtaggactctgtagacacggtgtcatctgagcgggctggcaaggc

SEQ ID NO: 2880 - DNA, 495 bp, Artificial Sequence
  Oligonucleotide
gcctccctcgcgccatcaggtagacactcgtgaagcctgcccttctcatggaaccctctgctggcctcccacgtaccccacattctggcctgacccctcagaagccagaccactgtcggcctgggaagtccaactgtcgacgtagacactcgtgaagtcacagtaatacaaggtcttgtccttggctttcacattggtcattttaaggtagactgcacttgaaagggtgttgcttgggactgttaatttacttgtactcatggagagtaaccctgataactcactgttgccacccacacaaatccctgtcatgaagcctgctggaccaagctcatgctgtagccagtacaagtgaaatcagaggctttgcaggagagtctgtgagaaccgctgggctgtacaatgtttccccctctgactccatcagtaagcttcaacaggacttacatgaacacagagggtagacactcgtgaagctgagcgggctggcaaggc

SEQ ID NO: 2881 - DNA, 495 bp, Artificial Sequence
  Oligonucleotide
gcctccctcgcgccatcaggtagacaccactagctcctgcccttctcatggaaccctctgctggcctcccacgtaccccacattctggcctgacccctcagaagccagaccactgtcggcctgggaagtccaactgtcgacgtagacaccactagcttcacacagtaatacacgcctgcatccccagccatcacacttctcagctgtaagttttcttgttttttactatgtgtttctggagatgctagctctgccctgaaggttggggcttagtgtttcccttaacccatatcacaccaacacactgaagaccttttgatgggagatggtggatccaggaaacagaatgttcagaaattgaatgtgcataggcggcataggtgaggctgagcatgaccaaggggaccactacttcttcctcccattgcacaaggtggtcctcactgtgaacccctgagaagtagacaccactagctctgagcgggctggcaaggc

SEQ ID NO: 2882 - DNA, 495 bp, Artificial Sequence
  Oligonucleotide
gcctccctcgcgccatcaggtagacacggtcaactcctgcccttctcatggaaccctctgctggcctcccacgtaccccacattctggcctgacccctcagaagccagaccactgtcggcctgggaagtccaactgtcgacgtagacacggtcaacttcagcacagtagtacacatctatgtcctcagatctctgactgctcagctccatgtaggctgtgctcgtggacgtgtccctggtcatggtgactctgccctgaaacttctgtgcatagcctgtgttaccattgccagagtagctccctaccatccattcaaacccttatccaggggcctgtcacacacagtgaatgtcgtagctggcgaaggtgtatccagagctttgcaggagaccttcactgaggccatggacgctggcaacaggagagtcatcagaagctgggtgagtcatataatcaggagtagacacggtcaactctgagcgggctggcaaggc

SEQ ID NO: 2883 - DNA, 495 bp, Artificial Sequence
  Oligonucleotide
gcctccctcgcgccatcaggtagacactacgtacgcctgcccttctcatggaaccctctgctggcctcccacgtaccccacattctggcctgacccctcagaagccagaccactgtcggcctgggaagtccaactgtcgacgtagacactacgtacgtcaacaggaatacacgaccatgtcttcagatctcaggctgctcagctccatgtaggctgtgctcacggacctgtcactggtaatggtgactctgccccggaacttctgtgcgtagtgtgtgttatcattgtaagggttgatgcatcccaaccactatgcccttgtccagggccctgtcgcacccactgtgtaaagtatttggtgaaggtgtatctggaagcctggccaggagaccttcactgaggacgcaggcttcttcacctcagccccaggctgcaacagctgaacctgggaatggacatcgtagacactacgtacgctgagcgggctggcaaggc

SEQ ID NO: 2884 - DNA, 495 bp, Artificial Sequence
  Oligonucleotide
gcctccctcgcgccatcaggtagacacatgacacccctgcccttctcatggaaccctctgctggcctcccacgtaccccacattctggcctgacccctcagaagccagaccactgtcggcctgggaagtccaactgtcgacgtagacacatgacacctcacacagtaatacatggccgtgtcttcagatctcaggctgctcagctccatgtaggctgtgctcgtggatgtgtccctggtcatggtgactctgccctggaacttctctgcgtagcttatgctgccatcactagggcacatccttcccatccactcaagcccttgtgcatgggcctggcgcacctagtgcatagagtaactggtgaaggtaggtgtatccacaagtcttgcaggagactttcactgatgccccagccttcttcatctcatccccagactgcaccagctgcacctgggactgggtagacacatgacaccctgagcgggctggcaaggc

SEQ ID NO: 2885 - DNA, 495 bp, Artificial Sequence
  Oligonucleotide
gcctccctcgcgccatcaggtagacaccttcacgacctgcccttctcatggaaccctctgctggcctcccacgtaccccacattctggcctgacccctcagaagccagaccactgtcggcctgggaagtccaactgtcgacgtagacaccttcacgatcacccagtaatacacagccgagtcctcagatctcaggctgctcagctctatgtaggctgtcctcagggacatgtccctggtaatggtgactctgccctggaacttctttgcatagttggtgttaccattgtaaagtgtgatccatctcatcctttcaagcccttgtccaggggcctgttgcaaccagtgcaaggagcagcaagtgaaggtgtatccggaagccttgcaggagaccttcactgaggccccaggcttctttacctcagcctcagactgccccagctgcacctgggagcagacacgtagacaccttcacgactgagcgggctggcaaggc

SEQ ID NO: 2886 - DNA, 495 bp, Artificial Sequence
  Oligonucleotide
gcctccctcgcgccatcaggtagacacagaatcagcctgcccttctcatggaaccctctgctggcctcccacgtaccccacattctggcctgacccctcagaagccagaccactgtcggcctgggaagtccaactgtcgacgtagacacagaatcagtcacacagtaatacacgaccatgtcttcagatctcaggctgctcagctccatgtaggctgtgctcatggacctgtcactggtaatggtgactctgccccagaacgtctgtgcatagtgtgtgttatcattgtaagggttgattcatcccatccactatgcccttgtccagggctttgtcacacccaccgtgtaaagtatttggtgaaggtgtatctggaagcctggcaggagaccttcactgaggacccaggcttcttcacctcagccccaggctgcaacagctgaacctgggaatggacaccgtagacacagaatcagctgagcgggctggcaaggc

SEQ ID NO: 2887 - DNA, 495 bp, Artificial Sequence
  Oligonucleotide
gcctccctcgcgccatcaggtagacacagttatgccctgcccttctcatggaaccctctgctggcctcccacgtaccccacattctggcctgacccctcagaagccagaccactgtcggcctgggaagtccaactgtcgacgtagacacagttatgctcatgcacagtaatgtgtggctgtgtccacaatgtccatgttgatcactgttagaaccacttcattcttggaggtgtccttggagataatgagcctactcttcagagatgggctgtagtatttattatcattctaataaatgtgtgcaagccactccagggcctttgctgagggctgacagatctaacccacacccattccagaagtgctgagtgagaacccagagaaggtgcaggtcagcatgagggtctgtgtgggtttcaccagtgcaggaccagactccttcaaggtgacctgggataagtagacacagttatgcctgagcgggctggcaaggc

SEQ ID NO: 2888 - DNA, 495 bp, Artificial Sequence
  Oligonucleotide
gcctccctcgcgccatcaggtagacacaggtctcacctgcccttctcatggaaccctctgctggcctcccacgtaccccacattctggcctgacccctcagaagccagaccactgtcggcctgggaagtccaactgtcgacgtagacacaggtctcatcacagagtcatatgcagctgcatcctctgccctcagtctgttcatttgcagatacagtgagtttttggtattgtctctggaaatggtgaatcggcccttcacagagtctgcgtagtacatggtactaccactaccactaataactgggacccactgcagacccttccctggagcctgggggacccagtgcgtgctatggctactgaaggtgaatccagaggctgcacaggagagtctcagggacacccaggctttgtcaagtttgctccagactctaccagctgcatctcacactggacaccgtagacacaggtctcactgagcgggctggcaaggc

SEQ ID NO: 2889 - DNA, 495 bp, Artificial Sequence
  Oligonucleotide
gcctccctcgcgccatcaggtagacacgtcatagtcctgcccttctcatggaaccctctgctggcctcccacgtaccccacattctggcctgacccctcagaagccagaccactgtcggcctgggaagtccaactgtcgacgtagacacgtcatagttcacacagtaatacacagccatgtcctcgggcctcaggctgttcatttgctgatacaggaagttcctggaattgtctctggagatgatgaatcggcccttcacagagtctgcatagtgcgtcctactgccattccaactaacacccgatacccactccagcccctttcctggagcctggcggacccagttcatgtcactgttactgaaggtgaatccagaggctgcacaggagagtctcagggaccccccaggctctaccaagcctcccccagactccaccagctgcactgttgtacccaggtgtagacacgtcatagtctgagcgggctggcaaggc

SEQ ID NO: 2890 - DNA, 495 bp, Artificial Sequence
  Oligonucleotide
gcctccctcgcgccatcaggtagacacgtgacttgcctgcccttctcatggaaccctctgctggcctcccacgtaccccacattctggcctgacccctcagaagccagaccactgtcggcctgggaagtccaactgtcgacgtagacacgtgacttgtcaacagtaatacacggccgtgtcctcggttttcaggctcttcatttgcagataggtgatgcttttggaatcatctcttgagattgtgaatctgcctttcacagacgtggtctattctgttgtcccaccattagctttgtttctaatgaaacctacccattccagccccttcccgggagcctggcggaccccgctcatgtagtagtaactgaaggtgaatccagaggctgcacaggagagtctcagggaccccccaggctgtaccaagcctcccccagactccaccagctgcacctcacactggtagacacgtgacttgctgagcgggctggcaaggc

SEQ ID NO: 2891 - DNA, 495 bp, Artificial Sequence
  Oligonucleotide
gcctccctcgcgccatcaggtagacacgattgcagcctgcccttctcatggaaccctctgctggcctcccacgtaccccacattctggcctgacccctcagaagccagaccactgtcggcctgggaagtccaactgtcgacgtagacacgattgcagtcaacactaatagagggccgtgtcctcggttttcaggctgttcatttgcagatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggataccgtagacacgattgcagctgagcgggctggcaaggc

SEQ ID NO: 2892 - DNA, 495 bp, Artificial Sequence
  Oligonucleotide
gcctccctcgcgccatcaggtagacacactatgaccctgcccttctcatggaaccctctgctggcctcccacgtaccccacattctggcctgacccctcagaagccagaccactgtcggcctgggaagtccaactgtcgacgtagacacactatgactcatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacgtagacacactatgacctgagcgggctggcaaggc

SEQ ID NO: 2893 - DNA, 495 bp, Artificial Sequence
  Oligonucleotide
gcctccctcgcgccatcaggtagacacatggtcaacctgcccttctcatggaaccctctgctggcctcccacgtaccccacattctggcctgacccctcagaagccagaccactgtcggcctgggaagtccaactgtcgacgtagacacatggtcaatcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacgtagacacatggtcaactgagcgggctggcaaggc

SEQ ID NO: 2894 - DNA, 495 bp, Artificial Sequence
  Oligonucleotide
gcctccctcgcgccatcaggtagacacgatggcttcctgcccttctcatggaaccctctgctggcctcccacgtaccccacattctggcctgacccctcagaagccagaccactgtcggcctgggaagtccaactgtcgacgtagacacgatggctttcatgtatagccatacacggccacgtcctcagctctctgagtgttcatttgcagatacagagagttcttagcattgtctttggagatggagaatctgcccttcacagagtctgcatggtgtatctgacttccatcatcttttatatctattactcactccagccccttgcctggagactggtgaactcggctcattcagaagctactgaaggcgaatctagaggctacacaggagagtctcaggaacttcccaggttgtctcaggtcctctatggactctatcagctccacctcacactgaacgtagacacgatggcttctgagcgggctggcaaggc

SEQ ID NO: 2895 - DNA, 495 bp, Artificial Sequence
  Oligonucleotide
gcctccctcgcgccatcaggtagacacagcatatgcctgcccttctcatggaaccctctgctggcctcccacgtaccccacattctggcctgacccctcagaagccagaccactgtcggcctgggaagtccaactgtcgacgtagacacagcatatgtcacatacagtaacacacagctgtgccctctgctctcagactgttcatttgcaaatacagtgagttcttggcattttctttggagatggtgaatttgctcttcacagattgggcataacatatctgacttccatcacactgtatatctactactcactccagccccttccctggagcctgggaaaccgagctcattcagtagctactgaaggttaatccagagtctgcacaggagagtctcaaggatcccccaggttgtcttgggtcctctccggactccacgagctgtacctctcactagacgtagacacagcatatgctgagcgggctggcaaggc

SEQ ID NO: 2896 - DNA, 495 bp, Artificial Sequence
  Oligonucleotide
gcctccctcgcgccatcaggtagacaccatatgctcctgcccttctcatggaaccctctgctggcctcccacgtaccccacattctggcctgacccctcagaagccagaccactgtcggcctgggaagtccaactgtcgacgtagacaccatatgcttcaagtaatacacagacctatcctcggctctgacgctgttcatttgcagatacagtgatttcttggcatcatctctggagagggtgaatcgacccttcacagagtctgcatagcttgtgctacctacacaacaactcataaatgagacctactccagccctttcccaggagcctgatggacccagctcatccagtacctaataaaggtactaaaggtgaatccagaggctgcaaaagaaagtctcagggacccccaggctataacaagcctcccaaagactccaccagctgcacctcacactggtagacaccatatgctctgagcgggctggcaaggc

SEQ ID NO: 2897 - DNA, 495 bp, Artificial Sequence
  Oligonucleotide
gcctccctcgcgccatcaggtagacactcgtcgatcctgcccttctcatggaaccctctgctggcctcccacgtaccccacattctggcctgacccctcagaagccagaccactgtcggcctgggaagtccaactgtcgacgtagacactcgtcgattcaacacagccgagtcctcatctctcagactgttcatttgcaagtacagcatgttcttgccattgtctctagagatggtgaatctacccttcagtgtctgcatagtataggctaccaccactagcactaatgtatgagacccattccagcccctttcttgaagcccggtgggcccagttcatgtcattgcttctcaagatgaatccgcaggctgcacatgagagtctcaggacacccccaaccccaccacagctgtaccaagtctcccccagactctaccagctgcacctcatactgcacaccgtagacactcgtcgatctgagcgggctggcaaggc

SEQ ID NO: 2898 - DNA, 495 bp, Artificial Sequence
  Oligonucleotide
gcctccctcgcgccatcaggtagacaccagtctgtcctgcccttctcatggaaccctctgctggcctcccacgtaccccacattctggcctgacccctcagaagccagaccactgtcggcctgggaagtccaactgtcgacgtagacaccagtctgttcaagtaatacatggccgtgtccttagctttcagactgtccatttgcagatagagcatgctcttagaattgtctcggagattgtgaatcggcccttcacagagtctgcatagtatttctgacttccatcattccagatatgtgccactcactccagccccttccctggagcctggcggacccagctcatgccatagctactaaaggagaatcctgaggctgcacaggagagtctcagggaccccccaggctggaccaagcctcccccagactccaccagctgcacctcacactggacacctgcgtagacaccagtctgtctgagcgggctggcaaggc

SEQ ID NO: 2899 - DNA, 495 bp, Artificial Sequence
  Oligonucleotide
gcctccctcgcgccatcaggtagacacaacgcgtacctgcccttctcatggaaccctctgctggcctcccacgtaccccacattctggcctgacccctcagaagccagaccactgtcggcctgggaagtccaactgtcgacgtagacacaacgcgtatcagtacagtaatagatggccgtgtactcggttttcagggtattcacttgcagatacagtgtgttctttgaatcatctcttgagatggtgaacctgcctttcacagatgcagcgcattctgtcgtgtaactgttacgtttggttctaatacggccaacccactccagccctttcccagaagcctggcggatccagtgcattcagaagtcactgaaggtgaatctagaagctgcaaatgagagtctcggggacccacccaggctgtaccaagcctcccccagactccaccagctgcgcctcacggtagacacaacgcgtactgagcgggctggcaaggc

SEQ ID NO: 2900 - DNA, 495 bp, Artificial Sequence
  Oligonucleotide
gcctccctcgcgccatcaggtagacacgtagttcgcctgcccttctcatggaaccctctgctggcctcccacgtaccccacattctggcctgacccctcagaagccagaccactgtcggcctgggaagtccaactgtcgacgtagacacgtagttcgtcaacaataatacacagccatgtcctcagctatcaggctgttcatttgaagatacaaggacttcttggcgttgtctctggagatggtgaatcggcccatcacggagtctgcatagtatgtatcaccaccagtaccaatagctgatacccactccggacccttccctggagcccggcgaacccagtgcagaacatagctactgaaggcgaatccagaggctgcacaggagggtctcagggaccccccaggctgtaccaagcctcccccagactccaccagctgatcctcacactggacacctgcgtagacacgtagttcgctgagcgggctggcaaggc

SEQ ID NO: 2901 - DNA, 495 bp, Artificial Sequence
  Oligonucleotide
gcctccctcgcgccatcaggtagacaccgaactaccctgcccttctcatggaaccctctgctggcctcccacgtaccccacattctggcctgacccctcagaagccagaccactgtcggcctgggaagtccaactgtcgacgtagacaccgaactactcatgactcaataatacagagccatattctcagctctcagactgttcatttgcagatacaacctgtgcttggcattgtctttggagatggtgaatctgaccttcacagagtctgcatattatgtctgacttccatcgtacattatatctactactcactgcagcccctttcctggagcctggcagattcagctgatctagtagctacagaaggtggattcagaggatgcacggcagagtctcaggcacattcagcttgtgccaactctccccaagactccaccatctgcaccccacactagacgtagacaccgaactacctgagcgggctggcaaggc

SEQ ID NO: 2902 - DNA, 495 bp, Artificial Sequence
  Oligonucleotide
gcctccctcgcgccatcaggtagacacttaacgtccctgcccttctcatggaaccctctgctggcctcccacgtaccccacattctggcctgacccctcagaagccagaccactgtcggcctgggaagtccaactgtcgacgtagacacttaacgtctcaacagtaatacacggtcatgtcctcagctctcaggctgttcacttgcagatagagggagttcttggcattgtctctggagatggtcaatcggcccttcacagagtctacatagtatttctcacttccgtcacactttatgtcggccacccactccagccccttctccggagcctggcagacccagtgcatccaggagctactgaaggtgaatccagaggctgcacaggagagtctcagggaccctccaggctgtaccaagcctcacccagactccaccagctgcacctcacactggacaccgtagacacttaacgtcctgagcgggctggcaaggc

SEQ ID NO: 2903 - DNA, 495 bp, Artificial Sequence
  Oligonucleotide
gcctccctcgcgccatcaggtagacacagcaacctcctgcccttctcatggaaccctctgctggcctcccacgtaccccacattctggcctgacccctcagaagccagaccactgtcggcctgggaagtccaactgtcgacgtagacacagcaaccttcacatacagtaatacacggccgtgccctctgctctcagactgttcatttgcaaacagagtgagttcttggcattttctttggagatggtgaatctgctcttcacagattgtgcataacatagctgacttctatcctactatatatctactactcactccagccccttccctggagcctgggaatctgagctcattcagtagctactgaaggttaatccagagtctgcacaggagagtctcagggatcccccaagttgtctttggttttcttcagactccaccagctgtacctcacactggacgtagacacagcaacctctgagcgggctggcaaggc

SEQ ID NO: 2904 - DNA, 495 bp, Artificial Sequence
  Oligonucleotide
gcctccctcgcgccatcaggtagacacttctcgagcctgcccttctcatggaaccctctgctggcctcccacgtaccccacattctggcctgacccctcagaagccagaccactgtcggcctgggaagtccaactgtcgacgtagacacttctcgagtcaacagtaatacacagccttgtccttggctttcaggttggtcattgtaaggtagactgcacatgaaaaggtgtcgcttgggactgttaatttatttgtactcatggagagtaactctgagaactcccacttgatcactcactgtttccacccacaccaatccctgtcatgaagcctgctggaccaagctcatgctgtagccagtaaaggtgaaatcagaggctttgcaggagagtctcagtgaaccactgggctgtacaattttctgcctctgactccatcaataaacttcacacaggacttgtagacacttctcgagctgagcgggctggcaaggc

SEQ ID NO: 2905 - DNA, 495 bp, Artificial Sequence
  Oligonucleotide
gcctccctcgcgccatcaggtagacacactctacgcctgcccttctcatggaaccctctgctggcctcccacgtaccccacattctggcctgacccctcagaagccagaccactgtcggcctgggaagtccaactgtcgacgtagacacactctacgtcaacacagtaatacacagccatgtcgtcggctctcaggctgttcatttgcagatacagtgaattctgggcattgtctctagagatggtgaatcagcccttcacagagtctgtgtagagtacggtatcaccacttgtactaataactgagacccactccaaaccctttcctggagcctggtggacccagtgcatagcagagctactgaaggtgaatccagaggctgcacaggagagtctcagagaccctcccagtctttactaagcctcccccagactccaccagctgcacctcacactggacgtagacacactctacgctgagcgggctggcaaggc

SEQ ID NO: 2906 - DNA, 495 bp, Artificial Sequence
  Oligonucleotide
gcctccctcgcgccatcaggtagacactaccggaacctgcccttctcatggaaccctctgctggcctcccacgtaccccacattctggcctgacccctcagaagccagaccactgtcggcctgggaagtccaactgtcgacgtagacactaccggaatcaacagtagtacacaactgtgccctcggctctcaggctgttcatttgcagagacagtgaattctgggcattgtctctggagatggtgaatcggcccttcacagagtctgtgtagagtacggtatcaccacttgtactaataactgagacccactacaaaccctttcttggagcctggcggacccagtgcatagcagagctactgaaggtgaatccagaggctgcacaggagagtctcagggaccccccaggctggaccaagccttccccagactccaccagctgcacctcacactggacaccgtagacactaccggaactgagcgggctggcaaggc

SEQ ID NO: 2907 - DNA, 495 bp, Artificial Sequence
  Oligonucleotide
gcctccctcgcgccatcaggtagacaccgaattgccctgcccttctcatggaaccctctgctggcctcccacgtaccccacattctggcctgacccctcagaagccagaccactgtcggcctgggaagtccaactgtcgacgtagacaccgaattgctcatgtacagccatgcatggtcatgtcctcagctctcagactgttcgtttggagatacggtgagttcttagcattgtctttggagatggtgaatctgcccttcacagagtctgcatggtatatctgacttccatcatattttacatctattactccctccagccccttccctagagtctcattgacccagctcattcagtagctactgaaggtgaatccagaggctacacaggagagtctcaggaacttcccaagttgtctcaggccctctatggactctatcagctccacctcacactgaacgtagacaccgaattgcctgagcgggctggcaaggc

SEQ ID NO: 2908 - DNA, 495 bp, Artificial Sequence
  Oligonucleotide
gcctccctcgcgccatcaggtagacacttcgctcacctgcccttctcatggaaccctctgctggcctcccacgtaccccacattctggcctgacccctcagaagccagaccactgtcggcctgggaagtccaactgtcgacgtagacacttcgctcatcagtatagtaatacacggccgtgtcctcggttttcaggctgttcatttgcagataggcgatgcttttggaatcatcgcttgagatggtgaatctgcctttcacagacgcggcgtattctgttgttccacgattagttttgtttttagtgaaacctacccactccagcccctttcctggagcccggcagatccactgcatgcagtagttaacggaaggtgaatccagaggctgcacaggagagtctcagggaccccccaggctgtaccaagcctcccccagactccaccagctgcacctcacagtagacacttcgctcactgagcgggctggcaaggc

SEQ ID NO: 2909 - DNA, 495 bp, Artificial Sequence
  Oligonucleotide
gcctccctcgcgccatcaggtagacacgacgttaacctgcccttctcatggaaccctctgctggcctcccacgtaccccacattctggcctgacccctcagaagccagaccactgtcggcctgggaagtccaactgtcgacgtagacacgacgttaatcaacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggtagacacgacgttaactgagcgggctggcaaggc

SEQ ID NO: 2910 - DNA, 495 bp, Artificial Sequence
  Oligonucleotide
gcctccctcgcgccatcaggtagacaccgtagagtcctgcccttctcatggaaccctctgctggcctcccacgtaccccacattctggcctgacccctcagaagccagaccactgtcggcctgggaagtccaactgtcgacgtagacaccgtagagttcacacagtaatacgtggctgtgtactcagctctcaaactgttcatttccagataagagtgtgttcttggcattgtttctggagatggggaatcagaacttcccagaatgtgcatagcgtatgctactcccatcagtactaatacatgagacccactccagtctgttccctggagcctggcaggcccagtgcatccagtggctactgaaggcaaatccagaggctgcacaggacagtctcagggacccccacccccaccgcgccaggctgtaccaagtctcccccaggctccaacaactgcgcgtagacaccgtagagtctgagcgggctggcaaggc

SEQ ID NO: 2911 - DNA, 495 bp, Artificial Sequence
  Oligonucleotide
gcctccctcgcgccatcaggtagacacttccggtacctgcccttctcatggaaccctctgctggcctcccacgtaccccacattctggcctgacccctcagaagccagaccactgtcggcctgggaagtccaactgtcgacgtagacacttccggtatcacagtaatagacggccatggtgtcagcaatgaaactgtttatttgcagatacagtgagttcttggtgttttctctggagatggtcaaccggcccttcacagagtctgagtagtatatgcctccaccactagcattaatgtaagacccactccagtcccttccctggagcttggtccacctagtgcatgccatagttactgaaagtgtatccagaggctgcacaggagagtcacatggaccccccaagctgtaccaagcctcccccagactctaccagctacacttcacattggacacctgcgtagacacttccggtactgagcgggctggcaaggc

SEQ ID NO: 2912 - DNA, 495 bp, Artificial Sequence
  Oligonucleotide
gcctccctcgcgccatcaggtagacacgcaattcgcctgcccttctcatggaaccctctgctggcctcccacgtaccccacattctggcctgacccctcagaagccagaccactgtcggcctgggaagtccaactgtcgacgtagacacgcaattcgtcacatacagtaacacacagctgtgccctctgctctcagactgttcatttgcaaatacagtgagttcttggcattttctttggagacggtgaatctgctcgtcacagattgtgcataacatatctgacttccatcacactgtatatctactactcactccagccccttccctggagcctgggaaaccgagctcattcagtagctactgaaggttaatccagaggctgcacaggagagtctcagggaacccaggttgtcttgggtcctctccagactccaccagctgtacctcacactggacacgtagacacgcaattcgctgagcgggctggcaaggc

SEQ ID NO: 2913 - DNA, 495 bp, Artificial Sequence
  Oligonucleotide
gcctccctcgcgccatcaggtagacactgagcgaacctgcccttctcatggaaccctctgctggcctcccacgtaccccacattctggcctgacccctcagaagccagaccactgtcggcctgggaagtccaactgtcgacgtagacactgagcgaatcaacagtaatacacagccgtgtcctcggctctcaggctgttcatttgcagatacagtgagttcttggcgttgtctctggagatggtgaatcggcccttcacagagtctgcgtagtatatggtactactactactaatggatgagacccactccagccccttccctggagcctggcggacccagttcatgtagtagtcactgaaggtgaatccagaggctgcacaggagagtctcagggaccccccaggctttaccaagcctcccccagactccaccagctgcacctcacactggacacctgcgtagacactgagcgaactgagcgggctggcaaggc

SEQ ID NO: 2914 - DNA, 495 bp, Artificial Sequence
  Oligonucleotide
gcctccctcgcgccatcaggtagacactactaagccctgcccttctcatggaaccctctgctggcctcccacgtaccccacattctggcctgacccctcagaagccagaccactgtcggcctgggaagtccaactgtcgacgtagacactactaagctcaacagtaatacacggccgtgtccgcggcggtcacagagctcagcttcaggtagaactggttcttggacgtgtctacggacatggtgattcgactcttgagggacgggttgtagtaggtgctcccactatgatggatttccccaatccactccagccccttccctgggggctggcggacccagattcaccagttaccactgctgatggagtcaccagagacagcgcagatgagggacagggtctccgaaggcttcaccagtcctgggcccgactcctgcagctgcacctgggacaggaccccgtagacactactaagcctgagcgggctggcaaggc

SEQ ID NO: 2915 - DNA, 495 bp, Artificial Sequence
  Oligonucleotide
gcctccctcgcgccatcaggtagacactggcgtatcctgcccttctcatggaaccctctgctggcctcccacgtaccccacattctggcctgacccctcagaagccagaccactgtcggcctgggaagtccaactgtcgacgtagacactggcgtattcactgcgcccgccccctccgcctccctgcggtcacagagctcagcttcagggaaaactggttcttggacgtttctattgacatggtgactcaactcctgagggacggggtgtagtagctcctcccactataatagatgtatccaatccattccagccccttccctggggactggcggaccagctccaccagttaccactgctgatggagtcaccagagacagcgcatgtgagggacagggtctccgaagcttcaccagtcctgggccccactcctgcagctgcactgggacaggacccctgtgtagacactggcgtatctgagcgggctggcaaggc

SEQ ID NO: 2916 - DNA, 495 bp, Artificial Sequence
  Oligonucleotide
gcctccctcgcgccatcaggtagacacgataaccacctgcccttctcatggaaccctctgctggcctcccacgtaccccacattctggcctgacccctcagaagccagaccactgtcggcctgggaagtccaactgtcgacgtagacacgataaccatcattagatggtccctctcacacaataatacatggcggcgtccgaggccttcaggctgctccactgcaggtaggcggtgctgctggagctgtcggctgagatggtgacgtggccttggaaggatgggctgtatctggtatcagagttcccaggatagatgctccccatccactccagttctttcccgggcatctggcgcacccagtggatccagtagctggtaaagctgtatccagaagtcttacaggagatcctcagagactccccgggtcttttcacctctgctgcagactgcaacagctggtagacacgataaccactgagcgggctggcaaggc

SEQ ID NO: 2917 - DNA, 495 bp, Artificial Sequence
  Oligonucleotide
gcctccctcgcgccatcaggtagacacctagtgaacctgcccttctcatggaaccctctgctggcctcccacgtaccccacattctggcctgacccctcagaagccagaccactgtcggcctgggaagtccaactgtcgacgtagacacctagtgaatcagcacgtgtcctcagcctttaggctgctgatatgaagatatgccatgctgacggaggtgtccatggagaagacaaaccgtcctgtgaagccctgggcatacgttaggttcccagtgttggtgttgatccatcccatttcctcaagcccttgtccatgggcctgtcatacccagctgatagcatagcttgtgaaggtgtatccagaagccttgcaggaaaccttcaatgaggctccaggcttcttcacctcaggcccagactgcaccagctgcacctgtgagtggacacctgtggagaggaggtagacacctagtgaactgagcgggctggcaaggc

SEQ ID NO: 2918 - DNA, 495 bp, Artificial Sequence
  Oligonucleotide
gcctccctcgcgccatcaggtagacacacgttcaccctgcccttctcatggaaccctctgctggcctcccacgtaccccacattctggcctgacccctcagaagccagaccactgtcggcctgggaagtccaactgtcgacgtagacacacgttcactcaacagtaatactcggccgtgtcctcagcctttaggctgctgatctgaagacacgccgtgctgacagacgtgtccatggagaagacaaaccatcctgtgaagccgtgggtatacgttgggttcccagtgtaggtgatgatccatcacatccactcaaagccctgtccaggggtctatcatacccaattcataccatagatggtgaaggtgtaaccagaagacttataggagaccttcactgaggccccaggcttcttcacctcaggcccagactgcaccagctgcagggagtgggcacctgtgtagacacacgttcacctgagcgggctggcaaggc

SEQ ID NO: 2919 - DNA, 448 bp, Artificial Sequence
  Oligonucleotide
gcctccctcgcgccatcaggtagacacattacgctcctgcccttctcatggaaccctctgctggcctcccacgtaccccacattctggcctgacccctcagaagccagaccactgtcggcctgggaagtccaactgtcgacgtagacacattacgcttcatctctcatacagtcatacacggccgtgtcctcagcctttaggctgctgatcttcagatacgccatgctgacagaggtgtccatggagaatagaaaccgtcctgtgaagccgttggtatatgttgggttcccagtgtaggtgatgatccatcccatccactcaagcccttgtccaggggctggtcacactgaattcataccatactggctgcatagtattccatgatttacatatatcatattttatctaatcagtagacacattacgctctgagcgggctggcaaggc

SEQ ID NO: 2920 - DNA, 495 bp, Artificial Sequence
  Oligonucleotide
gcctccctcgcgccatcaggtagacaccattgagtcctgcccttctcatggaaccctctgctggcctcccacgtaccccacattctggcctgacccctcagaagccagaccactgtcggcctgggaagtccaactgtcgacgtagacaccattgagttcaacacagtaataaatggctgcatcctcagtctttaggcagctagtctgcagatccgccgtgctgacagaggtgtccatggagaagacaaaccgtgtgtgaatctgtgggcatacattgggttcaccagggtaggatgatccatcccatccactcaagcccctgtcctggggtctgtcgtatccaattcataccataggtgatgacagtttaaccagacaccttgcaggagaccttcgccgaggccccaggctgcttcacctcaggcccagactgcaccagctgcactcgggagtgggcaccgtagacaccattgagtctgagcgggctggcaaggc

SEQ ID NO: 2921 - DNA, 300 bp, Artificial Sequence; identical to SEQ ID NO: 1749
  Oligonucleotide

SEQ ID NO: 2922 - DNA, 300 bp, Artificial Sequence
  Oligonucleotide
tctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcag

SEQ ID NO: 2923 - DNA, 300 bp, Artificial Sequence
  Oligonucleotide
ttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcag

SEQ ID NO: 2924 - DNA, 300 bp, Artificial Sequence
  Oligonucleotide
ttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcag

SEQ ID NO: 2925 - DNA, 300 bp, Artificial Sequence
  Oligonucleotide
tcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcag

SEQ ID NO: 2926 - DNA, 300 bp, Artificial Sequence
  Oligonucleotide
tccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcag

SEQ ID NO: 2927 - DNA, 300 bp, Artificial Sequence
  Oligonucleotide
tccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcag

SEQ ID NO: 2928 - DNA, 300 bp, Artificial Sequence
  Oligonucleotide
cttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagca

SEQ ID NO: 2929 - DNA, 300 bp, Artificial Sequence
  Oligonucleotide
ttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagca

SEQ ID NO: 2930 - DNA, 300 bp, Artificial Sequence
  Oligonucleotide
cttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaa

SEQ ID NO: 2931 - DNA, 300 bp, Artificial Sequence
  Oligonucleotide
cttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagca

SEQ ID NO: 2932 - DNA, 300 bp, Artificial Sequence
  Oligonucleotide
cttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagca

SEQ ID NO: 2933 - DNA, 300 bp, Artificial Sequence
  Oligonucleotide
cttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagca

SEQ ID NO: 2934 - DNA, 300 bp, Artificial Sequence
  Oligonucleotide
cttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagca

SEQ ID NO: 2935 - DNA, 300 bp, Artificial Sequence
  Oligonucleotide
cttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagca

SEQ ID NO: 2936 - DNA, 300 bp, Artificial Sequence
  Oligonucleotide
cttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcag

SEQ ID NO: 2937 - DNA, 300 bp, Artificial Sequence
  Oligonucleotide
cttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcag

SEQ ID NO: 2938 - DNA, 300 bp, Artificial Sequence; identical to SEQ ID NO: 2937
  Oligonucleotide

SEQ ID NO: 2939 - DNA, 300 bp, Artificial Sequence
  Oligonucleotide
cttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcag

SEQ ID NO: 2940 - DNA, 300 bp, Artificial Sequence
  Oligonucleotide
cttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcag

SEQ ID NO: 2941 - DNA, 300 bp, Artificial Sequence
  Oligonucleotide
cttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcag

SEQ ID NO: 2942 - DNA, 300 bp, Artificial Sequence
  Oligonucleotide
cttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcag

SEQ ID NO: 2943 - DNA, 300 bp, Artificial Sequence
  Oligonucleotide
gttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcag

SEQ ID NO: 2944 - DNA, 300 bp, Artificial Sequence
  Oligonucleotide
cttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcag

SEQ ID NO: 2945 - DNA, 300 bp, Artificial Sequence
  Oligonucleotide
ctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcag

SEQ ID NO: 2946 - DNA, 300 bp, Artificial Sequence
  Oligonucleotide
ctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcag

SEQ ID NO: 2947 - DNA, 300 bp, Artificial Sequence
  Oligonucleotide
ctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcag

SEQ ID NO: 2948 - DNA, 300 bp, Artificial Sequence
  Oligonucleotide
ttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcag

SEQ ID NO: 2949 - DNA, 300 bp, Artificial Sequence
  Oligonucleotide
tttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaag

SEQ ID NO: 2950 - DNA, 300 bp, Artificial Sequence
  Oligonucleotide
ttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcag

SEQ ID NO: 2951 - DNA, 300 bp, Artificial Sequence
  Oligonucleotide
ttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcag

SEQ ID NO: 2952 - DNA, 300 bp, Artificial Sequence
  Oligonucleotide
ttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcag

SEQ ID NO: 2953 - DNA, 300 bp, Artificial Sequence
  Oligonucleotide
ctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcag

SEQ ID NO: 2954 - DNA, 300 bp, Artificial Sequence
  Oligonucleotide
ctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcag

SEQ ID NO: 2955 - DNA, 300 bp, Artificial Sequence
  Oligonucleotide
ttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcag

SEQ ID NO: 2956 - DNA, 300 bp, Artificial Sequence
  Oligonucleotide
tctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagca

SEQ ID NO: 2957 - DNA, 300 bp, Artificial Sequence
  Oligonucleotide
ctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcag

SEQ ID NO: 2958 - DNA, 300 bp, Artificial Sequence
  Oligonucleotide
ctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcag

SEQ ID NO: 2959 - DNA, 300 bp, Artificial Sequence
  Oligonucleotide
ttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcag

SEQ ID NO: 2960 - DNA, 300 bp, Artificial Sequence
  Oligonucleotide
cccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcag

SEQ ID NO: 2961 - DNA, 300 bp, Artificial Sequence
  Oligonucleotide
cttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcag

SEQ ID NO: 2962 - DNA, 300 bp, Artificial Sequence
  Oligonucleotide
ccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcag

SEQ ID NO: 2963 - DNA, 300 bp, Artificial Sequence
  Oligonucleotide
ttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcag

SEQ ID NO: 2964 - DNA, 300 bp, Artificial Sequence
  Oligonucleotide
ttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcg

SEQ ID NO: 2965 - DNA, 300 bp, Artificial Sequence
  Oligonucleotide
tttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcag

SEQ ID NO: 2966 - DNA, 300 bp, Artificial Sequence
  Oligonucleotide
cttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcag

SEQ ID NO: 2967 - DNA, 300 bp, Artificial Sequence
  Oligonucleotide
tttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtgg

SEQ ID NO: 2968 - DNA, 300 bp, Artificial Sequence
  Oligonucleotide
ttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcag

SEQ ID NO: 2969 - DNA, 300 bp, Artificial Sequence
  Oligonucleotide
tcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcag

SEQ ID NO: 2970 - DNA, 300 bp, Artificial Sequence
  Oligonucleotide
tttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccag

SEQ ID NO: 2971 - DNA, 300 bp, Artificial Sequence
  Oligonucleotide
ctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcag

SEQ ID NO: 2972 - DNA, 300 bp, Artificial Sequence
  Oligonucleotide
ttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtag

SEQ ID NO: 2973 - DNA, 300 bp, Artificial Sequence
  Oligonucleotide
cctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctc

SEQ ID NO: 2974 - DNA, 300 bp, Artificial Sequence
  Oligonucleotide
ttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtag

SEQ ID NO: 2975 - DNA, 300 bp, Artificial Sequence
  Oligonucleotide
aggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgc

SEQ ID NO: 2976 - DNA, 300 bp, Artificial Sequence
  Oligonucleotide
ctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcag

SEQ ID NO: 2977 - DNA, 300 bp, Artificial Sequence
  Oligonucleotide
ttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctggga

SEQ ID NO: 2978 - DNA, 300 bp, Artificial Sequence
  Oligonucleotide
tcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcag

SEQ ID NO: 2979 - DNA, 300 bp, Artificial Sequence
  Oligonucleotide
atttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagt

SEQ ID NO: 2980 - DNA, 300 bp, Artificial Sequence
  Oligonucleotide
tcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcag

SEQ ID NO: 2981 - DNA, 300 bp, Artificial Sequence
  Oligonucleotide
ccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcag

SEQ ID NO: 2982 - DNA, 300 bp, Artificial Sequence
  Oligonucleotide
ttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcag

SEQ ID NO: 2983 - DNA, 300 bp, Artificial Sequence
  Oligonucleotide
gtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcag

SEQ ID NO: 2984 - DNA, 300 bp, Artificial Sequence
  Oligonucleotide
actaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgt

SEQ ID NO: 2985 - DNA, 300 bp, Artificial Sequence
  Oligonucleotide
tatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctg

SEQ ID NO: 2986 - DNA, 300 bp, Artificial Sequence
  Oligonucleotide
tctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccg

SEQ ID NO: 2987 - DNA, 300 bp, Artificial Sequence
  Oligonucleotide
cagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatg

SEQ ID NO: 2988 - DNA, 300 bp, Artificial Sequence; identical to SEQ ID NO: 1749
  Oligonucleotide

SEQ ID NO: 2989 - DNA, 100 bp, Artificial Sequence; identical to SEQ ID NO: 1750
  Oligonucleotide

SEQ ID NO: 2990 - DNA, 100 bp, Artificial Sequence
  Oligonucleotide
tatggctacaccttcggttcggggaccaggttaaccgttgtaggtaaggctgggggtctctaggaggggtgcgatgagggaggactctgtcctgggaaat

SEQ ID NO: 2991 - DNA, 100 bp, Artificial Sequence
  Oligonucleotide
gaaacaccatatattttggagagggaagttggctcactgttgtaggtgagtaagtcaaggctggacagctgggaacttgcaaaaaggggctggaatccag

SEQ ID NO: 2992 - DNA, 100 bp, Artificial Sequence
  Oligonucleotide
aatgaaaaactgttttttggcagtggaacccagctctctgtcttgggtatgtaaaagacttctttcgggatagtgtatcataaggtcggagttccaggag

SEQ ID NO: 2993 - DNA, 100 bp, Artificial Sequence
  Oligonucleotide
atcagccccagcattttggtgatgggactcgactctccatcctaggtaagttgcagaatcagggtggtatggccattgtcccttgaaggcagagttctct

SEQ ID NO: 2994 - DNA, 100 bp, Artificial Sequence
  Oligonucleotide
ataattcacccctccactttgggaacgggaccaggctcactgtgacaggtatgggggctccactcttgactcgggggtgcctgggtttgactgcaatgat

SEQ ID NO: 2995 - DNA, 100 bp, Artificial Sequence
  Oligonucleotide
acaatgagcagttcttcgggccagggacacggctcaccgtgctaggtaagaagggggctccaggtgggagagagggtgagcagcccagcctgcacgaccc

SEQ ID NO: 2996 - DNA, 100 bp, Artificial Sequence
  Oligonucleotide
accggggagctgttttttggagaaggctctaggctgaccgtactgggtaaggaggcggttggggctccggagagctccgagagggcgggatgggcagagg

SEQ ID NO: 2997 - DNA, 100 bp, Artificial Sequence
  Oligonucleotide
agatacgcagtattttggcccaggcacccggctgacagtgctcggtaagcgggggctcccgctgaagccccggaactggggagggggcgccccgggacgc

SEQ ID NO: 2998 - DNA, 100 bp, Artificial Sequence
  Oligonucleotide
aaaacattcagtacttcggcgccgggacccggctctcagtgctgggtaagctggggccgccgggggaccggggacgagactgcgctcgggtttttgtgcg

SEQ ID NO: 2999 - DNA, 100 bp, Artificial Sequence
  Oligonucleotide
gagacccagtacttcgggccaggcacgcggctcctggtgctcggtgagcgcgggctgctggggcgcgggcgcgggcggcttgggtctggtttttgcgggg

SEQ ID NO: 3000 - DNA, 100 bp, Artificial Sequence
  Oligonucleotide
gggccaacgtcctgactttcggggccggcagcaggctgaccgtgctgggtgagttttcgcgggaccacccgggcggcgggattcaggtggaaggcggcgg

SEQ ID NO: 3001 - DNA, 100 bp, Artificial Sequence
  Oligonucleotide
acgagcagtacttcgggccgggcaccaggctcacggtcacaggtgagattcgggcgtctccccaccttccagcccctcggtccccggagtcggagggtgg

SEQ ID NO: 3002 - DNA, 300 bp, Artificial Sequence
  Oligonucleotide
agtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctgg

SEQ ID NO: 3003 - DNA, 300 bp, Artificial Sequence
  Oligonucleotide
cagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctgg

SEQ ID NO: 3004 - DNA, 300 bp, Artificial Sequence
  Oligonucleotide
cagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctgg

SEQ ID NO: 3005 - DNA, 300 bp, Artificial Sequence
  Oligonucleotide
cagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctgg

SEQ ID NO: 3006 - DNA, 300 bp, Artificial Sequence
  Oligonucleotide
cagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctgg

SEQ ID NO: 3007 - DNA, 300 bp, Artificial Sequence
  Oligonucleotide
cagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctgg

SEQ ID NO: 3008 - DNA, 300 bp, Artificial Sequence
  Oligonucleotide
agtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccacct

SEQ ID NO: 3009 - DNA, 300 bp, Artificial Sequence
  Oligonucleotide
agtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccacct

SEQ ID NO: 3010 - DNA, 300 bp, Artificial Sequence
  Oligonucleotide
cagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctgg

SEQ ID NO: 3011 - DNA, 300 bp, Artificial Sequence
  Oligonucleotide
gcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtgg

SEQ ID NO: 3012 - DNA, 300 bp, Artificial Sequence
  Oligonucleotide
ttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcg

SEQ ID NO: 3013 - DNA, 300 bp, Artificial Sequence
  Oligonucleotide
gggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggatt

SEQ ID NO: 3014 - DNA, 300 bp, Artificial Sequence
  Oligonucleotide
tccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctgg

SEQ ID NO: 3015 - DNA, 300 bp, Artificial Sequence
  Oligonucleotide
gcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaactatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgctt

SEQ ID NO: 3016 - DNA, 100 bp, Artificial Sequence
  Oligonucleotide
attataagaaactctttggcagtggaacaacacttgttgtcacaggtaagtatcggaagaatacaacatttccaaggtaatagagggaaggcaggaaatg

SEQ ID NO: 3017 - DNA, 100 bp, Artificial Sequence
  Oligonucleotide
attataagaaactctttggcagtggaacaacacttgttgtcacaggtaagtatcggaagaatacaacatttccaaggtaatagagggaaagcaggaaatt

SEQ ID NO: 3018 - DNA, 100 bp, Artificial Sequence
  Oligonucleotide
aagagttgggcaaaaaaatcaaggtatttggtcccggaacaaagcttatcattacaggtaagttttctttaaattttgcaatgtaaagaagggatgggag

SEQ ID NO: 3019 - DNA, 100 bp, Artificial Sequence
  Oligonucleotide
actggttggttcaagatatttgctgaagggactaagctcatagtaacttcacctggtaagtaacttttctttctgtttttattccagtaatgaaaaactg

SEQ ID NO: 3020 - DNA, 100 bp, Artificial Sequence
  Oligonucleotide
agtgattggatcaagacgtttgcaaaagggactaggctcatagtaacttcgcctggtaagtaattttttttctgtttttattccagtaatgaaaaactga

SEQ ID NO: 3021 - DNA, 300 bp, Artificial Sequence
  Oligonucleotide
agcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgc

SEQ ID NO: 3022 - DNA, 300 bp, Artificial Sequence
  Oligonucleotide
tgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgc

SEQ ID NO: 3023 - DNA, 300 bp, Artificial Sequence
  Oligonucleotide
tgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgc

SEQ ID NO: 3024 - DNA, 300 bp, Artificial Sequence
  Oligonucleotide
tgcccactcccaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgc

SEQ ID NO: 3025 - DNA, 300 bp, Artificial Sequence
  Oligonucleotide
cacccacgcccaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgc

SEQ ID NO: 3026 - DNA, 300 bp, Artificial Sequence
  Oligonucleotide
tgcctactcccagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgc

SEQ ID NO: 3027 - DNA, 300 bp, Artificial Sequence
  Oligonucleotide
tgctcactcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgc

SEQ ID NO: 3028 - DNA, 300 bp, Artificial Sequence
  Oligonucleotide
tgcccactcccaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgc

SEQ ID NO: 3029 - DNA, 300 bp, Artificial Sequence
  Oligonucleotide
tgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgc

SEQ ID NO: 3030 - DNA, 300 bp, Artificial Sequence
  Oligonucleotide
tgcccactcccaggtccagctggtgcagtcttgggctgaggtgaggaagtctggggcctcagtgaaagtctcctgtagtttttctgggtttaccatcaccagctacggtatacattgggtgcaacagtcccctggacaagggcttgagtggatgggatggatcaaccctggcaatggtagcccaagctatgccaagaagtttcagggcagattcaccatgaccagggacatgtccacaaccacagcctacacagacctgagcagcctgacatctgaggacatggctgtgtattactatgc

SEQ ID NO: 3031 - DNA, 300 bp, Artificial Sequence
  Oligonucleotide
cacccacgccgaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgc

SEQ ID NO: 3032 - DNA, 300 bp, Artificial Sequence
  Oligonucleotide
tgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcac

SEQ ID NO: 3033 - DNA, 300 bp, Artificial Sequence
  Oligonucleotide
tgtcccaggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcac

SEQ ID NO: 3034 - DNA, 300 bp, Artificial Sequence
  Oligonucleotide
tatcccaggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcac

SEQ ID NO: 3035 - DNA, 300 bp, Artificial Sequence
  Oligonucleotide
tgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgc

SEQ ID NO: 3036 - DNA, 300 bp, Artificial Sequence
  Oligonucleotide
tccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaa

SEQ ID NO: 3037 - DNA, 300 bp, Artificial Sequence
  Oligonucleotide
tgtccagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgc

SEQ ID NO: 3038 - DNA, 300 bp, Artificial Sequence
  Oligonucleotide
aggtgtccagtgtgaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgc

SEQ ID NO: 3039 - DNA, 300 bp, Artificial Sequence
  Oligonucleotide
gtgtgaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtac

SEQ ID NO: 3040 - DNA, 300 bp, Artificial Sequence
  Oligonucleotide
tgtccagtgtgaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgt

SEQ ID NO: 3041 - DNA, 300 bp, Artificial Sequence
  Oligonucleotide
tgtccagtgtgaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgc

SEQ ID NO: 3042 - DNA, 300 bp, Artificial Sequence
  Oligonucleotide
tgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgc

SEQ ID NO: 3043 - DNA, 300 bp, Artificial Sequence
  Oligonucleotide
tgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgc

SEQ ID NO: 3044 - DNA, 300 bp, Artificial Sequence
  Oligonucleotide
tgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgc

SEQ ID NO: 3045 - DNA, 300 bp, Artificial Sequence; identical to SEQ ID NO: 3044
  Oligonucleotide

SEQ ID NO: 3046 - DNA, 300 bp, Artificial Sequence
  Oligonucleotide
tgtccagtgtcaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgc

SEQ ID NO: 3047 - DNA, 300 bp, Artificial Sequence
  Oligonucleotide
tgtccagtgtgaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgt

SEQ ID NO: 3048 - DNA, 300 bp, Artificial Sequence
  Oligonucleotide
tgcaggtgtccagtgtgaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgc

SEQ ID NO: 3049 - DNA, 300 bp, Artificial Sequence
  Oligonucleotide
tccagtgtgaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaa

SEQ ID NO: 3050 - DNA, 300 bp, Artificial Sequence
  Oligonucleotide
tgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgc

SEQ ID NO: 3051 - DNA, 300 bp, Artificial Sequence
  Oligonucleotide
atgtgaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtac

SEQ ID NO: 3052 - DNA, 300 bp, Artificial Sequence
  Oligonucleotide
aggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgc

SEQ ID NO: 3053 - DNA, 300 bp, Artificial Sequence
  Oligonucleotide
tgtccagtgtgaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgc

SEQ ID NO: 3054 - DNA, 300 bp, Artificial Sequence
  Oligonucleotide
aggtgtccagtgtgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgc

SEQ ID NO: 3055 - DNA, 300 bp, Artificial Sequence
  Oligonucleotide
gtgtgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgc

SEQ ID NO: 3056 - DNA, 300 bp, Artificial Sequence
  Oligonucleotide
gtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtac

SEQ ID NO: 3057 - DNA, 300 bp, Artificial Sequence
  Oligonucleotide
tgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgc

SEQ ID NO: 3058 - DNA, 300 bp, Artificial Sequence
  Oligonucleotide
tgtccagtgtcaggtgcagctggtggagtctgggggaggcgtggtccagcctggggggtccctgagactctcctgtgcagcgtctggattcaccttcagtagctatggcatgcactgggtccgccaggctccaggcaaggggctggagtgggtggcatttatacggtatgatggaagtaataaatactatgcagactccgtgaagggccgattcaccatctccagagacaattccaagaacacgctgtatctgcaaatgaacagcctgagagctgaggacacggctgtgtattactgtgc

SEQ ID NO: 3059 - DNA, 300 bp, Artificial Sequence
  Oligonucleotide
tgcaggtgtccagtgtgaggtgcagctggtggagtctcggggagtcttggtacagcctggggggtccctgagactctcctgtgcagcctctggattcaccgtcagtagcaatgagatgagctgggtccgccaggctccagggaagggtctggagtgggtctcatccattagtggtggtagcacatactacgcagactccaggaagggcagattcaccatctccagagacaattccaagaacacgctgcatcttcaaatgaacagcctgagagctgaggacacggctgtgtattactgtaa

SEQ ID NO: 3060 - DNA, 300 bp, Artificial Sequence
  Oligonucleotide
aggggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgc

SEQ ID NO: 3061 - DNA, 300 bp, Artificial Sequence
  Oligonucleotide
ggtcctgtcccaggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgc

SEQ ID NO: 3062 - DNA, 300 bp, Artificial Sequence
  Oligonucleotide
cctgtcccagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggccgtgtattactgtgc

SEQ ID NO: 3063 - DNA, 300 bp, Artificial Sequence
  Oligonucleotide
cctgtcccaggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgc

SEQ ID NO: 3064 - DNA, 300 bp, Artificial Sequence
  Oligonucleotide
cctgccccaggtgcagctgcaggagtcgggcccaggactggtgaagccttcacagaccctgtccctcacctgtactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgc

SEQ ID NO: 3065 - DNA, 300 bp, Artificial Sequence
  Oligonucleotide
aggggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgc

SEQ ID NO: 3066 - DNA, 300 bp, Artificial Sequence
  Oligonucleotide
cctgtcccagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgc

SEQ ID NO: 3067 - DNA, 300 bp, Artificial Sequence
  Oligonucleotide
aggggtcctgtcccaggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgc

SEQ ID NO: 3068 - DNA, 300 bp, Artificial Sequence
  Oligonucleotide
cctgtcccaggtgcagctgcaggagtcgggcccaggactggtgaagccttcggagaccctgtccctcacctgcactgtctctggtggctccgtcagcagtggtggttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgc

SEQ ID NO: 3069 - DNA, 300 bp, Artificial Sequence
  Oligonucleotide
ggtcctgtcccaggtgcagctgcaggagtcgggcccaggactggtgaagccttcggagaccctgtccctcacctgcgctgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgc

SEQ ID NO: 3070 - DNA, 300 bp, Artificial Sequence
  Oligonucleotide
agtctgtgccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgc

SEQ ID NO: 3071 - DNA, 300 bp, Artificial Sequence
  Oligonucleotide
agtctgtgccgaagtgcagctggtgcagtctggagcagaggtgaaaaagcccggggagtctctgaggatctcctgtaagggttctggatacagctttaccagctactggatcagctgggtgcgccagatgcccgggaaaggcttggagtggatggggaggattgatcctagtgactcttataccaactacagcccgtccttccaaggccacgtcaccatctcagctgacaagtccatcagcactgcctacctgcagtggagcagcctgaaggcctcggacaccgccatgtattactgtgc

SEQ ID NO: 3072 - DNA, 300 bp, Artificial Sequence
  Oligonucleotide
acaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgc

SEQ ID NO: 3073 - DNA, 300 bp, Artificial Sequence
  Oligonucleotide
tgcccactcccaggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatctgcagcctaaaggctgaggacactgccgtgtattactgtgc

SEQ ID NO: 3074 - DNA, 300 bp, Artificial Sequence
  Oligonucleotide
tacctactcccaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctccatggacacctctgccagcacagcatacctgcagatcagcagcctaaaggctgaggacatggccatgtattactgtgc

SEQ ID NO: 3075 - DNA, 300 bp, Artificial Sequence
  Oligonucleotide
gaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattccc

SEQ ID NO: 3076 - DNA, 300 bp, Artificial Sequence
  Oligonucleotide
cctatgaaaaaaattgtgtttttcagtgcactcatgttctagtaaagccctcagagaccctctccttcacctgtgctgtctctggatttccaatcataaccagtacttcctcctggagctgtatctgccagcccccagggaagaagctgaagtgggtcaggtgtgtaggtcacgaggaaacacacagtgcaacccgcttctcaagagtccagtcaccacctccagatccacattcagaaaacagtttttcctacagctgagctacccgcacaatgagtaaaccaccatggatttttatac

SEQ ID NO: 3077 - DNA, 300 bp, Artificial Sequence
  Oligonucleotide
tgtgcatgccgacaactgtgattctcggtgcactcctggcctggtgaagccctcacagatcctccccctggcctgtggcatctctgcttctccattacaaccagtgcttcctgctggagctggatccgtcaccccccggggaagggactggagcgaatcaggtgcacaggtcatgagggagtgcacaatccaacccactcctcaagagtccagtcaccatctccagatccacatccaaaaaacagtttctcctacagctgagctaccttaacaaggagtacacaaccatgatttttatac

SEQ ID NO: 3078 - DNA, 300 bp, Artificial Sequence
  Oligonucleotide
gtcccaggtgcagctgcaggagtcaggtccaggacccatgaggccctcagacactgccctctgcctgtgctgtgtctggattcttttttttaccatggatattatttgagatgaatccaccatcccgtgggcaacaggctggaatggctggggcacagttactagactggatcatcaaggaatacacatcatgcaccctccacccaggtccatgtccccatcaacagtgactcaaccaagagccagttctctgtgaagctcagctccatgaccacctaggacacggctgagtattactgt

SEQ ID NO: 3079 - DNA, 300 bp, Artificial Sequence
  Oligonucleotide
tgtgttgcccagaacctgttaacatcaacaactatgtttctcagcacacttctggcttgagactccttgcagaccctctcctcacctgcactgtctctggattccccatcataaccagtgtttcctgctagaattgtatctgcttgcccctagaagatggacaggagtggatcaggtgcatgggttgtgaagggagcacaaattacaacccactgctcaagagtccatatccagatccaagaaacagttcttacagctgagctctgtgcccagtgaacacacaactacgcatttttaagc

SEQ ID NO: 3080 - DNA, 300 bp, Artificial Sequence
  Oligonucleotide
ctgccaacaactgtatttctcggtgcactcttggcctggtgaagccttcacagaacctctccctcacctgtgccatctctgcattctccatcacaaccagtgtttcctgctggagctgcatccatcagcgcccccatgggaggtactggagtggatcgggtgcataggtcatggagggagcacaaattactcccctcttctcaagagtccagtcaccatctccagatccatgtccaaaaagtagttcttcttacagctgaactatgtgaggaacaaacacatagccatgtattttagagc

SEQ ID NO: 3081 - DNA, 300 bp, Artificial Sequence
  Oligonucleotide
tgttgtccagaaactgttaacatcaacaactgtgttttccagtgcacttctggcttgagacatcctcacagaccctctccctcacctgcactgtctctggattccccatcataaccagtgtgtcctgctagaattgtatctgcttgcccctagaagatggacaggagtggatcaggttcatgggttgtaaagggagcaaaaattacatcccacttctcaagagtccatatccagatccaagaaacagttcttacagctgagctctgtgcccagtgaacacacaactacacattttgaagc

SEQ ID NO: 3082 - DNA, 300 bp, Artificial Sequence
  Oligonucleotide
ctgccaacaactgtatttctcggtgcactcttggcctggtgaagccttcacagaacctctccctcacctgtgccatctctgcattctccatcacaaccagtgtttccttctggagctgcatccatcagcgcccccatgggaggtactggagtggatcgggtgcataggtcatggagggagcacagattactcccctcttctcaagagtccagtcaccatctccagatccatgtccaaaaagtacttcttcttacaggtgaactatgtgagcaacaaacacatagccatgtattttagagc

SEQ ID NO: 3083 - DNA, 300 bp, Artificial Sequence
  Oligonucleotide
gggtttccaatgtatcatccagaacttgtgcatgctaacaactgtttttctcagtcaattatcagcctggtgaagcccttgcaaaccccctcactcacctgtgctgcctctggattctctgtcacaatcagtgcttcctgtaggcactggatggaaagcacaggagtgggtcaggtgcatacgtgatgagtggaggatgaattccagcccacttatcatgaattcagacaagcccacatgttcccacatgcactatatcttcagacaagcagatgtgtctgcacatgaattcttctttca

SEQ ID NO: 3084 - DNA, 300 bp, Artificial Sequence
  Oligonucleotide
ctgagattgacaggcttacaagtgtcttagtccagcagttttcggtaacaggctatccactttcattttctcttcctcacatgccccatttctgggttgtccatcccaaccaacagttactgctggagctgaatccactagcccgcttccatgggctgtcaggaacacattgcaagggtgacacacacgatgatccatctctgcagagccaactctccttctccagagattcatccaagaaacaattttgactatacctgagctctgtgacatctgaggacatggtttgtattactgtgc

SEQ ID NO: 3085 - DNA, 300 bp, Artificial Sequence
  Oligonucleotide
agctgcaggagtcagccctggacctgaatagcacacacttaccctctgcctcacctacactgttactggccactccgtcacaaccagtccttactagtggacctggatctgccggctctcagggaggggctgcaatggataaaatccattgctagtggtggtgggagtccatttgtcttgtggaaaatggcagcatttccttattttataaggcataataatgctatgttgtgtacacataccacattgtctttatccatttgcccattgacagacacttagtttccatatcttggctgt

SEQ ID NO: 3086 - DNA, 300 bp, Artificial Sequence
  Oligonucleotide
gtgcatgccgacatctgtatttctcgtgcgttcttggcctggcgaagccctcacagaccctctccctcatctgtgctgtctctgcttctccatcacaaccagtgcttcctgctggagctggatccctcagctccccagggaagggactggagtgaatcaggtgcacaggtcatgagggagaacacaacgcaacccacgcctcaagagtccagtcaccatctccagatccacatccaaaacacagtttcttctacagctgagctacctgagcaacgagtacacaaccatgaatttttacac

SEQ ID NO: 3087 - DNA, 300 bp, Artificial Sequence
  Oligonucleotide
ccagaagccatgcacaccaaccactgtgtttcatggtcatttattggcctggtgaggccctcacagaccccctccctcacctgtgctgtctctggattctccatcacaactagtgcttcctgctggagctggatccgccagtcctcagtcaagggagtggatcagggcataggtcacgagggagcacaaattctaacccactcctcatgagctcagtcaccatctccagatccacgtccaagaaccaaattttcttttagctgagttctgtgaccaacaatgccacaaccttgtattact

SEQ ID NO: 3088 - DNA, 300 bp, Artificial Sequence
  Oligonucleotide
gtgcatgccaacaactgtgtttctcagtgcccacttggcctggtgaagccctcacagaccctctccctcacctgtgctgtctctggattccccatcacaaccagtgcttcctgctgtagctgcattcataaaccccccaggaagggactggagtgaatccagtgcacaggtcatgagggagtgcacattccaacccactcctcaagagtccagtcaccatctccagatccatgtccaaaaagcagttcttcctacagccgagctaagtgagtcacaagcacacagccatgtatttttaac

SEQ ID NO: 3089 - DNA, 300 bp, Artificial Sequence
  Oligonucleotide
tgtgctcacaaacaactgtgtttcttagtgcactcttggcctggtggagccctcgcagaccctctccctcacctgtgctgtctctggattttccatcacaaccagtgtttcctgctggagctggatccacgagtccacatgggaaggactggagtggaccaggcgcacacgtcatgaagggagcaaaaattcccacccactccttatgaatccagtcaccatctccaaattcgggtccaaaaaacacttgtttttacagtggagctatgtgagcaacaagctcacagccatgttttaaag

SEQ ID NO: 3090 - DNA, 300 bp, Artificial Sequence
  Oligonucleotide
cctgccaacaactgtgtttctcggtgcactcttggcctggtgaagcccccaaagaccctctccctcatgtgtgtcatctctgcattctccatcacaaccagtgcttcctcctggatctgcatccatcaccccctctctgggagggaatggagtggattgggtccatagatgatgaagggagcacacattactcccctttcctcaagagtccagtcaccatccccagatccatgtccaaaaacagttcttcctacagctgagctacatgagcaacaatcacatagccatatatttttcagc

SEQ ID NO: 3091 - DNA, 300 bp, Artificial Sequence
  Oligonucleotide
gcatgccaacaactgtgtttctcctgcactcttgggctagtgaagctctcacagaccctctctctcacctgtgctgtctctgcattctccatcacaaccagtgcttcctgctggagctgcatccatcaccccccgcaaggaagggactggagcgaatcaggtgcacaggtcatgagggagtgcacattccaacccactcctcaagagtccagtcactatctccagatccacatccaaaaaacagtgtttcctgtagctgagctacctgagcaacaagtacacaaccatgaattttaatac

SEQ ID NO: 3092 - DNA, 300 bp, Artificial Sequence
  Oligonucleotide
atgccaacaactgtgtttctcagcgcactcttggcctggtgaagccctcacagaccctctcccttacctgcgctgtgtctgtgttccccgtgataacgaggtcttcctgctgaagctggatccatcagccccccagggaagggaatggagtggattgggtgcataggtcatgaagggagcacacattaccacccactcctcaagtgtccagtcaccatccccagatccgtgtccaaaaaagcagttcttcctacagctgagctacatgagcaacaagcacatagccatgtatttttaagc

SEQ ID NO: 3093 - DNA, 300 bp, Artificial Sequence
  Oligonucleotide
acggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgt

SEQ ID NO: 3094 - DNA, 149 bp, Artificial Sequence
  Oligonucleotide
aatagattttctcaggatttgtttgtccgacagagtatttatttgtctttgatttatcatctcaagagacaatgtcaagaagatgctgtttctgcaaatgggcaatctgcaaaccaaggacacgtcactacattactgtgcaagagaag

SEQ ID NO: 3095 - DNA, 300 bp, Artificial Sequence
  Oligonucleotide
aaccacaaaggtttactggatctatatttttgtctttggcaaaatagcctggctattctcttagcttcttctgcaaagcatcaagattcaccttcactgactgcagcatttattgggccctgatggctggaggagaggggctggagtgggtggtagccatgagtgacccaagtggaagttctcagtggtgctctgctccagcacaaagaagattcacagttcctggggacaacacttaacatcacaatctcccttaaaattatctactggaaagctgaggagtaggcagtgtattactgt

SEQ ID NO: 3096 - DNA, 300 bp, Artificial Sequence
  Oligonucleotide
ttttcagaagtcccctgtgaagttaactaatggagttagacagagaaatactacagaccaggaattctgccttttctgcaaagcctctggattcactttcactgaaaacagcataagcttgatccagcaggcttcatgacaggggtgggtgtgggtaataacaataattcaaatagaagttctcagtgggactctccttgagtaaaaagatgattaacaatcctcaaatacactcagttcaggagattctcttttaagatgattaacctgagagctcaggaaaagtccgtgtattacttt

SEQ ID NO: 3097 - DNA, 300 bp, Artificial Sequence
  Oligonucleotide
gaagtcctgtgtgaaatttactgatagagtcaggggggaaaattgtacagcccagtggttcactgagactctcatgcaaagcctctgatttcacctttactggctacagcatgagcttggtccagcaggcttcatgacagggattggtgtgggtggaaacagtgagtgatcaagtgggagttctcagagttactctccatgagtacaaataaattaacagtcccaagcgacaccttttcatgtgcagtctaccttaaagggaccaaactgaaagtcaaggacaaggccttgtaatactgt

SEQ ID NO: 3098 - DNA, 300 bp, Artificial Sequence
  Oligonucleotide
agtcctgtgtgatgtttactgatggagtcagaaggagaaaaatttaacagcccagcagttcactgagactgtcctgcaaagcctctggtttcgggtttactgggtgcagcatgagcttggtccagcacgcttcacaacaggaattggtgtgggtagcaacagtgagagatcatatgggagttctaagggttactctccatgagtacagataaatcaacattcccaagtgacaccctttcaagtgcagtctaccttacaaggaccaacctgaaagccaagggcaaggccgtatattacagt

SEQ ID NO: 3099 - DNA, 300 bp, Artificial Sequence
  Oligonucleotide
tctgtgtgtgcagaagtcctctgtgaagttaactagtggagtcagacaggaaaatactacagaccaagaattctcagactgttctgcaaagcccctggattcactgaaaaaagaacaagtttggtccagcaggattcatggcaagtgttggtgagggagataacagtaattcaagtggaagttctcaatgggactcgccttcagtacaaagaagattaacagtcctcagagacactgttcagaagattctcttttaagataataaaactgagagcccaagacaagtctgtgtattactgt

SEQ ID NO: 3100 - DNA, 300 bp, Artificial Sequence
  Oligonucleotide
tccatgggttacaaaataatgggttggcttttcttccaacactttacagacaccatcaattttcctcttgcttataaggttttaaccagaagaatgctgtcatcatctttcctgttcttttagaaagaatgccccctcaactcatctccacttgtctgcatgtatttctatttgtctttggttttcagcagttttaataagattcacctaaatgtgtgtgtgtgtgtcgaggggtgttatgctattgttctgtgttctctgagatgcatggattcaccgtttactctgtctccatttttg

SEQ ID NO: 3101 - DNA, 300 bp, Artificial Sequence
  Oligonucleotide
agaggtcccctgtgaagttaattactggagtctctcagagaaatactacagaccaagaattctcagacttttctggaaaccctgtggattcactttcactgaaaacagcataagcttggtccagcaggcttcatgacaggggtgggtgtaggtgataacatcagtaattcaagtggaagttctcagtgggactctccttgagtacaaagaagattaacagtcctcagagacacgcttttcagatgattctctcttaagatgattaacctgagagctcaggaaaattccgtttattactgt

SEQ ID NO: 3102 - DNA, 300 bp, Artificial Sequence
  Oligonucleotide
tatccagggtgaggcccagcttacagagtctgggggagacttggtacactgagaggggcccctgaggctctcctgtgcagcctcttggttcaccttcagtatctatgagattcactgggtttgccaggcctcagggaaggggctggaatgggttgcagttatatggcgtagtgaaagtcatcaatacaatgcagactatgttaggggcagactcaccacttccagagacaacaccaagtacatgctgtacatgcaaatgaacagcctgagaacccagaacatggcagcatttaactgtgc

SEQ ID NO: 3103 - DNA, 149 bp, Artificial Sequence
  Oligonucleotide
aataggttttctcaggttttattggtccgacagaatatttatttgtctttgatttattgtctccagagacaatgtcaagaatatgctatatctgcaaatgggcgatctgtaaaccaagaacacatcagtatatcactgtgcaagaggag

SEQ ID NO: 3104 - DNA, 300 bp, Artificial Sequence
  Oligonucleotide
tactggatctatatttttatctttggcaaaacagcctggctgttctcttagcctcttttgcaaagcatcaagattcaccttcactgactacagcataaattgagcccagatggctgggggacagaggctggagtgggtggtaacagtgattgattcaagtggaagttctcagtgatattctgcatcagcataatgaagattcacaattcccagggacaccaattaccagcacagtctcccttaaaataatctacttggaagctgagggggctctcacaggggtaggcagtgtattactgt

SEQ ID NO: 3105 - DNA, 300 bp, Artificial Sequence
  Oligonucleotide
aagtcctgtatgaagttcagtggtggagtcagaggggtaaacgtagtacagcccagtggttcactgagactttcttgcaaagcgtctggattcaccttttctggcaacagcctgaggttggtccagcaggcttcacaacagggattgtggtggctggcaacagtgagtcaacaagtgggagtgctcaggtttactcttcatgagtacaaataaattaactggtccagcgacaccctttcacgtgcactctaccttacaatgactaacctgaaagccaaggacaaggttgtgtaatactgt

SEQ ID NO: 3106 - DNA, 300 bp, Artificial Sequence
  Oligonucleotide
agtcctacaagaagttcactggtggaatctggaagagaaatgatacagcctaactgttctcagagccttttttacaaagcctctgaatttaccttcattgactctagcatgagctcagcccagcaggcttcaggacaggggttggtgtgggaggcaaaagcgagggattcaagtggaatttgttagtggtaccctccatcaatacaaagaaaaatcataatcctcagggacacccttgtcagcacagtctccctcaaaatgaccaacctgagagccgaggagaaggccatgtattactgt

SEQ ID NO: 3107 - DNA, 300 bp, Artificial Sequence
  Oligonucleotide
ctctgtgttcatgtaagtcctgttgaagcttactgatggagtcagagggggaaacattgtacagcccagcggttctcacagactctcctgcaaagcctctgatttcacttgtactggctacagcatgagcttggtccagcaggcttcatgacagggatttgtgtgggtggcaacagtgagttatcagggttactctccatgagtacaagtaaattaacagtcccaagcaacaccctttcaagtgcagtctaccttaaaatgaccaatgtgaaagccaaggacaagaccttgtattactgt

SEQ ID NO: 3108 - DNA, 300 bp, Artificial Sequence
  Oligonucleotide
tctcaggggttcacagtgaggaccaccttgtgcaatgggaggaagaagtagtggtccccttggtcatgctcagcctcacctatgccgcctatgcacattcaatttctgaacattctgtttcctggatccaccatctcccatcaaaaggtcttcagtgtgttggtgtgatatgggttaagggaaacactaagccccaaccttcagggcagagctagcatctccagaaacacatagtaaaaaacaagaaaacttacagctgagaagtgtgatggctggggatgcaggcgtgtattactgtgc

SEQ ID NO: 3109 - DNA, 300 bp, Artificial Sequence
  Oligonucleotide
tcctgattatatgactcacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatggagctgagcagtcagagatctgaggacatagatgtgtactactgtgc

SEQ ID NO: 3110 - DNA, 300 bp, Artificial Sequence
  Oligonucleotide
tgtccattcccaggttcagctgttgcagcctggggctgaggtgaagaagcctgcgtcctcagtgaaggtctcctggccaggcttccagatacaccttcaccaaatactttacacagtgggtgcgacagggccctggacaagggcatagtggttgggatgcatcaacccttacaatgataacacacactacgcacagaagttccggggcagagtcaccattaccagtgacaggtccgtgagcacagcctacatggagctgagcagcctgagatctgaagacatggtcgtgtattcctgtgt

SEQ ID NO: 3111 - DNA, 300 bp, Artificial Sequence
  Oligonucleotide
cagtcccaggtgcagctggtgcagtctggggatgagatgaagaaggctggggcatcagtgaaagtctcctgcaagacttgtggatacacctaccttcaccagttactctatgcactaggtgcgccaggcccatgcacaagggcttgagtggatgggaaggatgtgccctagtgatggcagcataagctacgcagagaagttccagggcagagtcaccatgaccagggacacatccacgagcacagcctacatggagctgagcagcctgagatctgaagacacggccatgtattactgtgg

SEQ ID NO: 3112 - DNA, 300 bp, Artificial Sequence
  Oligonucleotide
tgtctgctcccaggtgcagctggggcagtctgaggctgaggtaaagaagcctggggcctcagtgaaggtctcctgcaaggcttccggatacaccttcacttgctgctccttgcactggttgcaacaggcccctggacaagggcttgaaaggatgagatggatcacactttacaatggtaacaccaactatgcaaagaagttccagggcagagtcaccattaccagggacatgtccctgaggacagcctacatagagctgagcagcctgagatctgaggactcggctgtgtattactgggc

SEQ ID NO: 3113 - DNA, 300 bp, Artificial Sequence
  Oligonucleotide
gtgtccattcccaggttcagctgttgcagcctggggctgaggtgaagaagcctgggtcctcagtgaaggtctcctgccaggcttccagatacaccttcaccaaatactttacacggtgggtgtgacaaagccctggacaagggcatagtggatgggatgaatcaacccttacaatgataacacacactatgcacagacgttctggggcagagtcaccattaccagtgacaggtccatgagcacagcctacatggagctgagcagcctgagatctgaagacatggtcgtgtattactgtgt

SEQ ID NO: 3114 - DNA, 300 bp, Artificial Sequence
  Oligonucleotide
tatcccaggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaa

SEQ ID NO: 3115 - DNA, 300 bp, Artificial Sequence
  Oligonucleotide
gtgtccagtgtgagatgcagctggtagagtctggagcaaacttgacaaagcctgggtgtccctgagactctcctgtgcagcctctggattcaccttcagtagccatagcacgcactgggtcccccaggctccagggaagggtctgcagtgggtcccagttattagtggtagtggtagtaccatgtactacgcagactctgtgaagggccgattcaccatttccagagacaataccaaaaactcactgtatctgcaaatgaacagactgagggcagaggatgcagctgcatatgactctgt

SEQ ID NO: 3116 - DNA, 300 bp, Artificial Sequence
  Oligonucleotide
cctgggtacaacagtgcagctggtggagtctgggggaggcttggtagagcctggggggtccctgagactctcctgtgcagcctctggattcaccttcagtaacagtgacatgaactgggtccgccaggctccaggaaaggggctggagtgggtatcgggtgttagttggaatggcagtaggacgcactatgcagactctgtgaagggccgattcatcatctccagagacaattccaggaacttcctgtatcagcaaatgaacagcctgaggcccgaggacatggctgtgtattactgtgt

SEQ ID NO: 3117 - DNA, 300 bp, Artificial Sequence
  Oligonucleotide
gtgtgaggtgcagctggtggagtctgggggaggcttggtacagcctggggggtccctgagactctcctgtgcagcctctggattcaccttcagttactactacatgagcggggtccgccaggctcccgggaaggggctggaatgggtaggtttcattagaaacaaagctaatggtgggacaacagaatagaccacgtctgtgaaaggcagattcacaatctcaagagatgattccaaaagcatcacctatctgcaaatgaagagcctgaaaaccgaggacacggccgtgtattactgttc

SEQ ID NO: 3118 - DNA, 300 bp, Artificial Sequence
  Oligonucleotide
tatccagtgtgagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtac

SEQ ID NO: 3119 - DNA, 300 bp, Artificial Sequence
  Oligonucleotide
ttcagtgtgaggtggagctgatagagcccacagaggacctgagacaacctgggaagttcctgagactctcctgtgtagcctctagattcgccttcagtagcttctgaatgagcccagttcaccagtctgcaggcaaggggctggagtgagtaatagatataaaagatgatggaagtcagatacaccatgcagactctgtgaagggcagattctccatctccaaagacaatgctaagaactctctgtatctgcaaatgaacagtcagagaactgaggacatggctgtgtatggctgtacat

SEQ ID NO: 3120 - DNA, 300 bp, Artificial Sequence
  Oligonucleotide
tctagtgagaggtacagctcgtggagtccggagaggacccaagacaacctgggggatccctgagactctcctgtgcagactctggattaaccttcagtagctactgaaggaactcggtttcccaggctccagggaaggggctggagtgagtagtagatatacagtgtgatggaagtcagatatgttatgcataatctttgaagagcaaattcaccatctccaaagaaaatgccaagaactcactgtatttgctaatgaacagtctgagagcagcgggcacagctgtgtgttactgtatgt

SEQ ID NO: 3121 - DNA, 300 bp, Artificial Sequence
  Oligonucleotide
ttcagtgtgaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgtgtatggctatacat

SEQ ID NO: 3122 - DNA, 300 bp, Artificial Sequence
  Oligonucleotide
tctagtgagaggtacagctcgtggagtccggagaggacccaagacaacctgggggatccttgagactctcctgtgcagactctggattaaccttcagtagctactgaatgagctcggtttcccaggctccagggaaggggctggagtgagtagtagatatacagtgtgatggaagtcagatatgttatgcccaatctgtgaagagcaaattcaccatctccaaagaaaatgccaagaactcactgtatttgcaaatgaacagtctgagagcagagggcacagctgtgtgttactgtatgt

SEQ ID NO: 3123 - DNA, 300 bp, Artificial Sequence
  Oligonucleotide
agtgtgaggtgcagctggtggagtctttgggaggcttgttatagcctgggggtccctgagactttcttttgcagcctctggattcacctttagtacctttattaggtactggatgagctgggtccatcaggctcctgggaaagggctggagtaggtctcatttatgagttgttgtgtaggtagcacaagctatgcagactctgtgaagggtcgattcaccctctccagagatgatgccaagaaatcactgtatctgcaaatgaacagcgtcagagccgaggataggtctgtgtattactg

SEQ ID NO: 3124 - DNA, 300 bp, Artificial Sequence
  Oligonucleotide
ggtgtgcagtatgaggtgcagctggtagagtctgggggagacttggtacagctgtggtggggttgggggtgtcctgagactctcatgtgcagcctgcggattcatcttgagaagcaatgacatgaactgggcccaccgggcttcaagaaaggggctggaatgggtctcatacattagtgctagtggtggtagcctatactatgcagacactgaagggtagattcaccatctctagagacaatggcaagaacatgctgtacttgcaaatgaacagtctgagagatgaggactcggctgtgt

SEQ ID NO: 3125 - DNA, 300 bp, Artificial Sequence
  Oligonucleotide
aggtgtccagtgtgaggtgcagctggtggagtctgggggaggcttggtccagcctggggggtccctgagactctcctgtgcagcctcaggattctcctttagtagctatggcatgagctgggtccgccaggctccagggaaggggctggagtgagtggcacatatctggaatgatggaagtcagaaatactatgcagactctgtgaagggccgattcacaatctccgagacaattctaagagcatgctctatctgcaaatggacagtctgaaagctaaggacacggccatgtattactgt

SEQ ID NO: 3126 - DNA, 300 bp, Artificial Sequence
  Oligonucleotide
cgtgaggcgcagctggtggagtctgggggaggcttggtacagcctgggtgggtccccgagactctcatttgcagcttctagattcaccttcagtgacttctgaatgcactggatccgccaggcttctgggaaagggctggagtgggttggccgtattagaaccaaacgtaacagttacacgacagaatgcgctgcatctgtgaaaggcaggttcaccatctcaagagatgattcaaagaacacactgtatctgcaagtgaataccctgaaaaccgagtacacggccatctattactgtac

SEQ ID NO: 3127 - DNA, 300 bp, Artificial Sequence
  Oligonucleotide
aggtgtccagtgtgaggatcagctggtggagtctgggggaggcttggtacagcctggggggtccctgagaccctcctgtgcagcctctggattcgccttcagtagctatgttctgcactgggttcgccgggctccagggaagggtccggagtgggtatcagctattggtactggtggtgatacatactatgcagactccgtgatgggccgattcaccatctccagagacaacgccaagaagtccttgtatcttcaaatgaacagcctgatagctgaggacatggctgtgtattattgtgc

SEQ ID NO: 3128 - DNA, 300 bp, Artificial Sequence
  Oligonucleotide
gtctagtgtggggtgcagatggtggagtcttggggagagttggcacaagctgaatgtgcctgagactctgccgtgcatcctctgaatccaccttctgtagctactagatcagctgaatctgccaggctccaggaaaggggctgcagtgagtagtagatataatgtacgatggaagtcagacataatatgcagactctgtgaaggtcagattcaccatctccaaagacaatgccaagcacaggttgtatctgcaaatgaacagtctgagagctgagaatatggctctgtattattgagtca

SEQ ID NO: 3129 - DNA, 300 bp, Artificial Sequence
  Oligonucleotide
tgtccagtgtgaggtgcagctggtggagtctgggtgaggcttggtacagcctggagggtccctgagactctcctgtgcagcctctggattcaccttcagtagctcctggatgcactgggtctgccaggctccggagaaggggctggagtgggtggccgacataaagtgtgacggaagtgagaaatactatgtagactctgtgaagggccgattgaccatctccagagacaatgccaagaactccctctatctgcaagtgaacagcctgagagctgaggacatgaccgtgtattactgtgt

SEQ ID NO: 3130 - DNA, 300 bp, Artificial Sequence
  Oligonucleotide
tccagtgtgaggtacagctggtggagtctgaagaaaaccaaagacaacttgggggatccctgagactctcctgtgcagactctggattaaccttcagtagctactgaatgagctcagattcccaggctccagggaaggggctggagtgagtagtagatatatagtaggatagaagtcagctatgttatgcacaatctgtgaagagcagattcaccatctccaaagaaaatgccaagaactcactctgtttgcaaatgaacagtctgagagcagagggcacggccgtgtattactgtatgt

SEQ ID NO: 3131 - DNA, 300 bp, Artificial Sequence
  Oligonucleotide
aagtcctgtgtgaagtttattgatggagtcagaggcagaaaattgtacagcccagtggttcactgagactctcctgcaaagcctctgatttcacctttactggctacagcatgagcttggtccagcaggcttcatgacagggattggtgtgggtggaaacagtgagtgatcaagtgggagttctcagagttactctccatgagtacaaataaattaacagtcccaagcgacaccttttcatgtgcagtctaccttacaatgaccaacctgaaagccaaggacaaggctgtgtattactgt

SEQ ID NO: 3132 - DNA, 300 bp, Artificial Sequence
  Oligonucleotide
gtccagtgtgaggtgcagctggtggagtctgggggaggcttagtaaagactgggagggtctctgagactctcctgtgcagcctctggattcaccttcagtagctctgctatgcactgggtccaccaggctccaggaaagggtttggagtgggtctcagttattagtacaagtggtgataccgtactctacacagactctgtgaagggctgattcaccatctctagagacaatgcccagaattcactgtatctgcaaatgaacagcctgagagccgacgacatggctgtgtattactgtgt

SEQ ID NO: 3133 - DNA, 300 bp, Artificial Sequence
  Oligonucleotide
tgtccagtgtgaggtgcagctggtggagtctggggaaggcttggtccagcctggggggtccctgagactctcctgtgcagcctctggattcaccttcagtagctctgctatgcactgggtccgccaggctccaagaaagggtttgtagtgggtctcagttattagtacaagtggtgataccgtactctacacagactctgtgaagggccgattcaccatctccagagacaatgcccagaattcactgtctctgcaaatgaacagcctgagagccgagggcacagttgtgtactactgtgt

SEQ ID NO: 3134 - DNA, 300 bp, Artificial Sequence
  Oligonucleotide
ttcagtgtgaggtggagctgatagagtccatagagggcctgagacaacttgggaagttcctgagactctcctgtgtagcctctggattcaccttcagtagctactgaatgagctgggtcaatgagactctagggaaggggctggagggagtaatagatgtaaaatatgatggaagtcagatataccatgcagactctgtgaagggcagattcaccatctccaaagacaatgctaagaactcaccgtatctccaaacgaacagtctgagagctgaggacatgaccatgcatggctgtacat

SEQ ID NO: 3135 - DNA, 300 bp, Artificial Sequence
  Oligonucleotide
tgtgaggtgcagctggtggagtctgggggaggcttggtacagcctggggggtccctgagactctcctgtgcagcctctggattcaccttccgttaactactgcatgcagtggatctgccgggctccaggaaaggggctggagtgggtaggtttcactaaaaacaaaactaatcgtggaacaacagaatacgccgcgtctgtgaaaggcagattcaccatctcaagcgatgattccaaaagcatcgcctatctgcaaatgaacagcctgaaaaccgaggacacggccgtgtattactatac

SEQ ID NO: 3136 - DNA, 300 bp, Artificial Sequence
  Oligonucleotide
gtgtgaggtgcagctggtggagtccgggggaggcttggtccagcctggggggtccctgagactctcctgtgcagcctctggattcaccttcagtgactactacatgagctgggtccgccaggctcccgggaaggggctggagtgggtaggtttcattagaaacaaagctaatggtgggacaacagaatagaccacgtctgtgaaaggcagattcacaatctcaagagatgattccaaaagcatcacctatctgcaaatgaacagcctgagagccgaggacacggccgtgtattactgtgc

SEQ ID NO: 3137 - DNA, 300 bp, Artificial Sequence
  Oligonucleotide
cgcagttgttggagcctgggggagacttggtacagcctggcgcggtgggggtgggggtccctgagactgtcctgtgcagcctctggatttgccttcagtagccactggatgcactgggcctgccaggctccagggaacagactggagtgggtctcatgtattagtactgatgggagtagcatacgctatgcacattctgggaagttctgattccccatctccagaaacaatgccaagaacacactcttatctggaaatgaacagtttgagagctgagtacacagccacgtattactgtgc

SEQ ID NO: 3138 - DNA, 300 bp, Artificial Sequence
  Oligonucleotide
caggtgtccaatgtgaagtgtagctggtagagtctgggggaggcttggtacagcttggggggtccatgtgactctcctgtgcagcctctggatacactttcagtaactatggcatgcactaggtggaccaagctccagggaagggactggagtgggtcttacattaatgctagtggtggaggcatatactactcagactctgtgaagggccggttgaccatctccagagaaaacaccaagaactcactgtatctgcaaataaacagtttcattgctgacaccatggccgtctattactgt

SEQ ID NO: 3139 - DNA, 300 bp, Artificial Sequence
  Oligonucleotide
tgtccagtgtgaggtacagctggtggagtctggagaggacccaagacaacctgggttccctgagactctcctgtgcagcctctggattaaccttcagtagctactgaatgagctcggtttcccaggctccagggaaggggctggagtgagtagtagatatacagtgtgatggaagtcagatatgttatgcacaatctgtgacgagcagattcaccgtctccaaagaaaatgccaagaactcactgtatttgcaaatgaacagtctgagagcagagggcacagctgtgtgttactgtatgt

SEQ ID NO: 3140 - DNA, 300 bp, Artificial Sequence
  Oligonucleotide
aggtgtccagtgtgaggtgcagctggtggagtctgggggaggcttggtaaagcctggggggtccctgagactctcctgtgcagcctctggattcaccttcagtgactactacatgaactgggtccgccaggctccagggaaggggctggagtgggtctcatccattagtagtagtagtaccatatactacgcagactctgtgaagggccgattcaccatctccagagacaacgccaagaactcactgtatctgcaaatgaacagcctgagagccgaggacacggctgtgtattactgtgc

SEQ ID NO: 3141 - DNA, 300 bp, Artificial Sequence
  Oligonucleotide
ggtcctgtcccaggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtccgtagacacgtccaagaaccagttctacctgaagctgagctctgtgaccgccgcggacacggccgtgtattactgtgc

SEQ ID NO: 3142 - DNA, 300 bp, Artificial Sequence
  Oligonucleotide
acaggggtcctgtcccagtgcagctgcaggagtggggcccaggactggtgaagcttcggagaccctgtccctcacatgcgctgtctctggtgactccatcagcagtggtaactggtggagctggtccgccagtccccagggaaggggctggaatggattggatacatctattatagtgggaggagctactacaccccgtccctcaggagttgagtcaccatgtcaatagaaacgtccaagaaccagttttccctgaagctgagctctgtgaccgcagggaggcggagggggcgggcgcag

SEQ ID NO: 3143 - DNA, 300 bp, Artificial Sequence
  Oligonucleotide
agctgttgcagtctgcagcagaggtgaaaagacccggggagtctctgaggatctcctgtaagacttctggatacagctttaccagctactggatccactgggtgcgccagatgcccgggaaagaactggagtggatggggagcatctatcctgggaactctgataccagatacagcccatccttccaaggccacgtcaccatctcagccgacagctccagcagcaccgcctacctgcagtggagcagcctgaaggcctcggacgccgccatgtattattgtgtgagagggaccatctaaa

SEQ ID NO: 3144 - DNA, 300 bp, Artificial Sequence
  Oligonucleotide
ctcctctccacaggtgtccactcacaggtgcagctggtgcagtctgggcctgaggtgaagaagcctggagcctcattgaaggtttcctgcaaggcttctggatacaccttcacaagctatgctatcagctgggtatgacaggcccatggacaagggcttgaggaaatgggatggatcaacaccaacactgggaacctaacgtatgcccagggcttcacaggacggtttgtcttctccatggacacctccgtcagcatggcatatcttcatatcagcagcctaaaggctgaggacacgtgc

SEQ ID NO: 3145 - DNA, 300 bp, Artificial Sequence
  Oligonucleotide
aggtgcccactccctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgc

SEQ ID NO: 3146 - DNA, 253 bp, Artificial Sequence
  Oligonucleotide
tgattagataaaatatgatatatgtaaatcatggaatactatgcagccagtatggtatgaattcagtgtgaccagcccctggacaagggcttgagtggatgggatggatcatcacctacactgggaacccaacatataccaacggcttcacaggacggtttctattctccatggacacctctgtcagcatggcgtatctgaagatcagcagcctaaaggctgaggacacggccgtgtatgactgtatgagaga

SEQ ID NO: 3147 - DNA, 300 bp, Artificial Sequence
  Oligonucleotide
ggtgcccactcccgagtgcagctggtgcagtctgggcctgaggtgaagcagcctggggcctcggcgaaggtctcctgcaaggtgtctggttaaactgtcatcacctatggtatgaattggatacgacagaccccaggacaggggcttgagtggatgggatggatcatcctaccctggtgaacccaatgtatgcccacagattcacacacggtttgtcttctccatggacacctctgtcagcacggcggatctgcagactagctgcctaaagactgaggatgcagccatttattactgtgt

SEQ ID NO: 3148 - DNA, 100 bp, Artificial Sequence
  Oligonucleotide
atacttccagcactggggccagggcaccctggtcaccgtctcctcaggtgagtctgctgtctggggatagcggggagccaggtgtactgggccaggcaag

SEQ ID NO: 3149 - DNA, 100 bp, Artificial Sequence
  Oligonucleotide
ggtacttcgatctctggggccgtggcaccctggtcactgtctcctcaggtgagtcccactgcagccccctcccagtcttctctgtccaggcaccaggcca

SEQ ID NO: 3150 - DNA, 100 bp, Artificial Sequence
  Oligonucleotide
cttttgatatctggggccaagggacaatggtcaccgtctcttcaggtaagatggctttccttctgcctcctttctctgggcccagcgtcctctgtcctgg

SEQ ID NO: 3151 - DNA, 100 bp, Artificial Sequence
  Oligonucleotide
tttgactactggggccagggaaccctggtcaccgtctcctcaggtgagtcctcacaacctctctcctgctttaactctgaagggttttgctgcatttctg

SEQ ID NO: 3152 - DNA, 100 bp, Artificial Sequence
  Oligonucleotide
tggttcgacccctggggccagggaaccctggtcaccgtctcctcaggtgagtcctcaccaccccctctctgagtccacttagggagactcagcttgccag

SEQ ID NO: 3153 - DNA, 100 bp, Artificial Sequence
  Oligonucleotide
tactactactactacatggacgtctggggcaaagggaccacggtcaccgtctcctcaggtaagaatggccactctagggcctttgttttctgctactgcc

SEQ ID NO: 3154 - DNA, 100 bp, Artificial Sequence
  Oligonucleotide
tgctgggggcccctggacccgacccgccctggagaccgcagccacatcagcccccagccccacaggccccctaccagccgcagggttttggctgagctga

SEQ ID NO: 3155 - DNA, 100 bp, Artificial Sequence
  Oligonucleotide
aagtgcttggagcactggggccagggcagcccggccaccgtctccctgggaacgtcacccctccctgcctgggtctcagcccgggggtctgtgtggctgg

SEQ ID NO: 3156 - DNA, 100 bp, Artificial Sequence
  Oligonucleotide
agttggacttcccaggccgacagtggtctggcttctgaggggtcaggccagaatgtggggtacgtgggaggccagcagagggttccatgagaagggcagg

SEQ ID NO: 3157 - DNA, 495 bp, Artificial Sequence
  Oligonucleotide
gccttgccagcccgctcagacacacgtgacactcttcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgacactctgtcgacactgaagctttctttggacaaggcaccagactcacagttgtaggtaagacatttttcaggttcttttgcagatccgtcacagggaaaagtgggtccacagacacacgtgacactctctgatggcgcgagggaggc

SEQ ID NO: 3158 - DNA, 495 bp, Artificial Sequence
  Oligonucleotide
gccttgccagcccgctcagacacacgtttcggaactcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtttcggaacgtcgactatggctacaccttcggttcggggaccaggttaaccgttgtaggtaaggctgggggtctctaggaggggtgcgatgagggaggactctgtcctgggaaatacacacgtttcggaacctgatggcgcgagggaggc

SEQ ID NO: 3159 - DNA, 495 bp, Artificial Sequence
  Oligonucleotide
gccttgccagcccgctcagacacacgtaagtaacgtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtaagtaacggtcgacgaaacaccatatattttggagagggaagttggctcactgttgtaggtgagtaagtcaaggctggacagctgggaacttgcaaaaaggggctggaatccagacacacgtaagtaacgctgatggcgcgagggaggc

SEQ ID NO: 3160 - DNA, 495 bp, Artificial Sequence
  Oligonucleotide
gccttgccagcccgctcagacacacgtgtctcctatcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgtctcctagtcgacaatgaaaaactgttttttggcagtggaacccagctctctgtcttgggtatgtaaaagacttctttcgggatagtgtatcataaggtcggagttccaggagacacacgtgtctcctactgatggcgcgagggaggc

SEQ ID NO: 3161 - DNA, 495 bp, Artificial Sequence
  Oligonucleotide
gccttgccagcccgctcagacacacgtagagtgtctcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtagagtgtcgtcgacatcagccccagcattttggtgatgggactcgactctccatcctaggtaagttgcagaatcagggtggtatggccattgtcccttgaaggcagagttctctacacacgtagagtgtcctgatggcgcgagggaggc

SEQ ID NO: 3162 - DNA, 495 bp, Artificial Sequence
  Oligonucleotide
gccttgccagcccgctcagacacacgtgttccgaatcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgttccgaagtcgacataattcacccctccactttgggaacgggaccaggctcactgtgacaggtatgggggctccactcttgactcgggggtgcctgggtttgactgcaatgatacacacgtgttccgaactgatggcgcgagggaggc

SEQ ID NO: 3163 - DNA, 495 bp, Artificial Sequence
  Oligonucleotide
gccttgccagcccgctcagacacacgtcgttactttcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtcgttacttgtcgacacaatgagcagttcttcgggccagggacacggctcaccgtgctaggtaagaagggggctccaggtgggagagagggtgagcagcccagcctgcacgacccacacacgtcgttacttctgatggcgcgagggaggc

SEQ ID NO: 3164 - DNA, 495 bp, Artificial Sequence
  Oligonucleotide
gccttgccagcccgctcagacacacgttaggagactcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgttaggagacgtcgacaccggggagctgttttttggagaaggctctaggctgaccgtactgggtaaggaggcggttggggctccggagagctccgagagggcgggatgggcagaggacacacgttaggagacctgatggcgcgagggaggc

SEQ ID NO: 3165 - DNA, 495 bp, Artificial Sequence
  Oligonucleotide
gccttgccagcccgctcagacacacgtgtgtctactcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgtgtctacgtcgacagatacgcagtattttggcccaggcacccggctgacagtgctcggtaagcgggggctcccgctgaagccccggaactggggagggggcgccccgggacgcacacacgtgtgtctacctgatggcgcgagggaggc

SEQ ID NO: 3166 - DNA, 495 bp, Artificial Sequence
  Oligonucleotide
gccttgccagcccgctcagacacacgtgtacagtgtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtgtacagtggtcgacaaaacattcagtacttcggcgccgggacccggctctcagtgctgggtaagctggggccgccgggggaccggggacgagactgcgctcgggtttttgtgcgacacacgtgtacagtgctgatggcgcgagggaggc

SEQ ID NO: 3167 - DNA, 495 bp, Artificial Sequence
  Oligonucleotide
gccttgccagcccgctcagacacacgtggatcatctcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtggatcatcgtcgacgagacccagtacttcgggccaggcacgcggctcctggtgctcggtgagcgcgggctgctggggcgcgggcgcgggcggcttgggtctggtttttgcggggacacacgtggatcatcctgatggcgcgagggaggc

SEQ ID NO: 3168 - DNA, 495 bp, Artificial Sequence
  Oligonucleotide
gccttgccagcccgctcagacacacgttattggcgtcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgttattggcggtcgacgggccaacgtcctgactttcggggccggcagcaggctgaccgtgctgggtgagttttcgcgggaccacccgggcggcgggattcaggtggaaggcggcggacacacgttattggcgctgatggcgcgagggaggc

SEQ ID NO: 3169 - DNA, 495 bp, Artificial Sequence
  Oligonucleotide
gccttgccagcccgctcagacacacgtaggcttgatcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagtgaacacacgtaggcttgagtcgacacgagcagtacttcgggccgggcaccaggctcacggtcacaggtgagattcgggcgtctccccaccttccagcccctcggtccccggagtcggagggtggacacacgtaggcttgactgatggcgcgagggaggc

SEQ ID NO: 3170 - DNA, 495 bp, Artificial Sequence
  Oligonucleotide
gccttgccagcccgctcagtagacggagacactcttctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagacactctgtcgacactgaagctttctttggacaaggcaccagactcacagttgtaggtaagacatttttcaggttcttttgcagatccgtcacagggaaaagtgggtccacagtagacggagacactctctgatggcgcgagggaggc

SEQ ID NO: 3171 - DNA, 495 bp, Artificial Sequence
  Oligonucleotide
gccttgccagcccgctcagtagacggattcggaactctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggattcggaacgtcgactatggctacaccttcggttcggggaccaggttaaccgttgtaggtaaggctgggggtctctaggaggggtgcgatgagggaggactctgtcctgggaaattagacggattcggaacctgatggcgcgagggaggc

SEQ ID NO: 3172 - DNA, 495 bp, Artificial Sequence
  Oligonucleotide
gccttgccagcccgctcagtagacggaaagtaacgtctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaaagtaacggtcgacgaaacaccatatattttggagagggaagttggctcactgttgtaggtgagtaagtcaaggctggacagctgggaacttgcaaaaaggggctggaatccagtagacggaaagtaacgctgatggcgcgagggaggc

SEQ ID NO: 3173 - DNA, 495 bp, Artificial Sequence
  Oligonucleotide
gccttgccagcccgctcagtagacggagtctcctatctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagtctcctagtcgacaatgaaaaactgttttttggcagtggaacccagctctctgtcttgggtatgtaaaagacttctttcgggatagtgtatcataaggtcggagttccaggagtagacggagtctcctactgatggcgcgagggaggc

SEQ ID NO: 3174 - DNA, 495 bp, Artificial Sequence
  Oligonucleotide
gccttgccagcccgctcagtagacggaagagtgtctctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaagagtgtcgtcgacatcagccccagcattttggtgatgggactcgactctccatcctaggtaagttgcagaatcagggtggtatggccattgtcccttgaaggcagagttctcttagacggaagagtgtcctgatggcgcgagggaggc

SEQ ID NO: 3175 - DNA, 495 bp, Artificial Sequence
  Oligonucleotide
gccttgccagcccgctcagtagacggagttccgaatctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagttccgaagtcgacataattcacccctccactttgggaacgggaccaggctcactgtgacaggtatgggggctccactcttgactcgggggtgcctgggtttgactgcaatgattagacggagttccgaactgatggcgcgagggaggc

SEQ ID NO: 3176 - DNA, 495 bp, Artificial Sequence
  Oligonucleotide
gccttgccagcccgctcagtagacggacgttactttctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggacgttacttgtcgacacaatgagcagttcttcgggccagggacacggctcaccgtgctaggtaagaagggggctccaggtgggagagagggtgagcagcccagcctgcacgaccctagacggacgttacttctgatggcgcgagggaggc

SEQ ID NO: 3177 - DNA, 495 bp, Artificial Sequence
  Oligonucleotide
gccttgccagcccgctcagtagacggataggagactctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggataggagacgtcgacaccggggagctgttttttggagaaggctctaggctgaccgtactgggtaaggaggcggttggggctccggagagctccgagagggcgggatgggcagaggtagacggataggagacctgatggcgcgagggaggc

SEQ ID NO: 3178 - DNA, 495 bp, Artificial Sequence
  Oligonucleotide
gccttgccagcccgctcagtagacggagtgtctactctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagtgtctacgtcgacagatacgcagtattttggcccaggcacccggctgacagtgctcggtaagcgggggctcccgctgaagccccggaactggggagggggcgccccgggacgctagacggagtgtctacctgatggcgcgagggaggc

SEQ ID NO: 3179 - DNA, 495 bp, Artificial Sequence
  Oligonucleotide
gccttgccagcccgctcagtagacggagtacagtgtctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggagtacagtggtcgacaaaacattcagtacttcggcgccgggacccggctctcagtgctgggtaagctggggccgccgggggaccggggacgagactgcgctcgggtttttgtgcgtagacggagtacagtgctgatggcgcgagggaggc

SEQ ID NO: 3180 - DNA, 495 bp, Artificial Sequence
  Oligonucleotide
gccttgccagcccgctcagtagacggaggatcatctctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaggatcatcgtcgacgagacccagtacttcgggccaggcacgcggctcctggtgctcggtgagcgcgggctgctggggcgcgggcgcgggcggcttgggtctggtttttgcggggtagacggaggatcatcctgatggcgcgagggaggc

SEQ ID NO: 3181 - DNA, 495 bp, Artificial Sequence
  Oligonucleotide
gccttgccagcccgctcagtagacggatattggcgtctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggatattggcggtcgacgggccaacgtcctgactttcggggccggcagcaggctgaccgtgctgggtgagttttcgcgggaccacccgggcggcgggattcaggtggaaggcggcggtagacggatattggcgctgatggcgcgagggaggc

SEQ ID NO: 3182 - DNA, 495 bp, Artificial Sequence
  Oligonucleotide
gccttgccagcccgctcagtagacggaaggcttgatctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgatagacggaaggcttgagtcgacacgagcagtacttcgggccgggcaccaggctcacggtcacaggtgagattcgggcgtctccccaccttccagcccctcggtccccggagtcggagggtggtagacggaaggcttgactgatggcgcgagggaggc

SEQ ID NO: 3183 - DNA, 495 bp, Artificial Sequence
  Oligonucleotide
gccttgccagcccgctcagcagctcttgacactctttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgacactctgtcgacactgaagctttctttggacaaggcaccagactcacagttgtaggtaagacatttttcaggttcttttgcagatccgtcacagggaaaagtgggtccacagcagctcttgacactctctgatggcgcgagggaggc

SEQ ID NO: 3184 - DNA, 495 bp, Artificial Sequence
  Oligonucleotide
gccttgccagcccgctcagcagctcttttcggaacttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttttcggaacgtcgactatggctacaccttcggttcggggaccaggttaaccgttgtaggtaaggctgggggtctctaggaggggtgcgatgagggaggactctgtcctgggaaatcagctcttttcggaacctgatggcgcgagggaggc

SEQ ID NO: 3185 - DNA, 495 bp, Artificial Sequence
  Oligonucleotide
gccttgccagcccgctcagcagctcttaagtaacgttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttaagtaacggtcgacgaaacaccatatattttggagagggaagttggctcactgttgtaggtgagtaagtcaaggctggacagctgggaacttgcaaaaaggggctggaatccagcagctcttaagtaacgctgatggcgcgagggaggc

SEQ ID NO: 3186 - DNA, 495 bp, Artificial Sequence
  Oligonucleotide
gccttgccagcccgctcagcagctcttgtctcctattcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgtctcctagtcgacaatgaaaaactgttttttggcagtggaacccagctctctgtcttgggtatgtaaaagacttctttcgggatagtgtatcataaggtcggagttccaggagcagctcttgtctcctactgatggcgcgagggaggc

SEQ ID NO: 3187 - DNA, 495 bp, Artificial Sequence
  Oligonucleotide
gccttgccagcccgctcagcagctcttagagtgtcttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttagagtgtcgtcgacatcagccccagcattttggtgatgggactcgactctccatcctaggtaagttgcagaatcagggtggtatggccattgtcccttgaaggcagagttctctcagctcttagagtgtcctgatggcgcgagggaggc

SEQ ID NO: 3188 - DNA, 495 bp, Artificial Sequence
  Oligonucleotide
gccttgccagcccgctcagcagctcttgttccgaattcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgttccgaagtcgacataattcacccctccactttgggaacgggaccaggctcactgtgacaggtatgggggctccactcttgactcgggggtgcctgggtttgactgcaatgatcagctcttgttccgaactgatggcgcgagggaggc

SEQ ID NO: 3189 - DNA, 495 bp, Artificial Sequence
  Oligonucleotide
gccttgccagcccgctcagcagctcttcgttacttttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttcgttacttgtcgacacaatgagcagttcttcgggccagggacacggctcaccgtgctaggtaagaagggggctccaggtgggagagagggtgagcagcccagcctgcacgaccccagctcttcgttacttctgatggcgcgagggaggc

SEQ ID NO: 3190 - DNA, 495 bp, Artificial Sequence
  Oligonucleotide
gccttgccagcccgctcagcagctctttaggagacttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctctttaggagacgtcgacaccggggagctgttttttggagaaggctctaggctgaccgtactgggtaaggaggcggttggggctccggagagctccgagagggcgggatgggcagaggcagctctttaggagacctgatggcgcgagggaggc

SEQ ID NO: 3191 - DNA, 495 bp, Artificial Sequence
  Oligonucleotide
gccttgccagcccgctcagcagctcttgtgtctacttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgtgtctacgtcgacagatacgcagtattttggcccaggcacccggctgacagtgctcggtaagcgggggctcccgctgaagccccggaactggggagggggcgccccgggacgccagctcttgtgtctacctgatggcgcgagggaggc

SEQ ID NO: 3192 - DNA, 495 bp, Artificial Sequence
  Oligonucleotide
gccttgccagcccgctcagcagctcttgtacagtgttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttgtacagtggtcgacaaaacattcagtacttcggcgccgggacccggctctcagtgctgggtaagctggggccgccgggggaccggggacgagactgcgctcgggtttttgtgcgcagctcttgtacagtgctgatggcgcgagggaggc

SEQ ID NO: 3193 - DNA, 495 bp, Artificial Sequence
  Oligonucleotide
gccttgccagcccgctcagcagctcttggatcatcttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttggatcatcgtcgacgagacccagtacttcgggccaggcacgcggctcctggtgctcggtgagcgcgggctgctggggcgcgggcgcgggcggcttgggtctggtttttgcggggcagctcttggatcatcctgatggcgcgagggaggc

SEQ ID NO: 3194 - DNA, 495 bp, Artificial Sequence
  Oligonucleotide
gccttgccagcccgctcagcagctctttattggcgttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctctttattggcggtcgacgggccaacgtcctgactttcggggccggcagcaggctgaccgtgctgggtgagttttcgcgggaccacccgggcggcgggattcaggtggaaggcggcggcagctctttattggcgctgatggcgcgagggaggc

SEQ ID NO: 3195 - DNA, 495 bp, Artificial Sequence
  Oligonucleotide
gccttgccagcccgctcagcagctcttaggcttgattcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagtgacagctcttaggcttgagtcgacacgagcagtacttcgggccgggcaccaggctcacggtcacaggtgagattcgggcgtctccccaccttccagcccctcggtccccggagtcggagggtggcagctcttaggcttgactgatggcgcgagggaggc

SEQ ID NO: 3196 - DNA, 495 bp, Artificial Sequence
  Oligonucleotide
gccttgccagcccgctcaggagcgatagacactctttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagacactctgtcgacactgaagctttctttggacaaggcaccagactcacagttgtaggtaagacatttttcaggttcttttgcagatccgtcacagggaaaagtgggtccacaggagcgatagacactctctgatggcgcgagggaggc

SEQ ID NO: 3197 - DNA, 495 bp, Artificial Sequence
  Oligonucleotide
gccttgccagcccgctcaggagcgatattcggaacttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatattcggaacgtcgactatggctacaccttcggttcggggaccaggttaaccgttgtaggtaaggctgggggtctctaggaggggtgcgatgagggaggactctgtcctgggaaatgagcgatattcggaacctgatggcgcgagggaggc

SEQ ID NO: 3198 - DNA, 495 bp, Artificial Sequence
  Oligonucleotide
gccttgccagcccgctcaggagcgataaagtaacgttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataaagtaacggtcgacgaaacaccatatattttggagagggaagttggctcactgttgtaggtgagtaagtcaaggctggacagctgggaacttgcaaaaaggggctggaatccaggagcgataaagtaacgctgatggcgcgagggaggc

SEQ ID NO: 3199 - DNA, 495 bp, Artificial Sequence
  Oligonucleotide
gccttgccagcccgctcaggagcgatagtctcctattcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagtctcctagtcgacaatgaaaaactgttttttggcagtggaacccagctctctgtcttgggtatgtaaaagacttctttcgggatagtgtatcataaggtcggagttccaggaggagcgatagtctcctactgatggcgcgagggaggc

SEQ ID NO: 3200 - DNA, 495 bp, Artificial Sequence
  Oligonucleotide
gccttgccagcccgctcaggagcgataagagtgtcttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataagagtgtcgtcgacatcagccccagcattttggtgatgggactcgactctccatcctaggtaagttgcagaatcagggtggtatggccattgtcccttgaaggcagagttctctgagcgataagagtgtcctgatggcgcgagggaggc

SEQ ID NO: 3201 - DNA, 495 bp, Artificial Sequence
  Oligonucleotide
gccttgccagcccgctcaggagcgatagttccgaattcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagttccgaagtcgacataattcacccctccactttgggaacgggaccaggctcactgtgacaggtatgggggctccactcttgactcgggggtgcctgggtttgactgcaatgatgagcgatagttccgaactgatggcgcgagggaggc

SEQ ID NO: 3202 - DNA, 495 bp, Artificial Sequence
  Oligonucleotide
gccttgccagcccgctcaggagcgatacgttacttttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatacgttacttgtcgacacaatgagcagttcttcgggccagggacacggctcaccgtgctaggtaagaagggggctccaggtgggagagagggtgagcagcccagcctgcacgacccgagcgatacgttacttctgatggcgcgagggaggc

SEQ ID NO: 3203 - DNA, 495 bp, Artificial Sequence
  Oligonucleotide
gccttgccagcccgctcaggagcgatataggagacttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatataggagacgtcgacaccggggagctgttttttggagaaggctctaggctgaccgtactgggtaaggaggcggttggggctccggagagctccgagagggcgggatgggcagagggagcgatataggagacctgatggcgcgagggaggc

SEQ ID NO: 3204 - DNA, 495 bp, Artificial Sequence
  Oligonucleotide
gccttgccagcccgctcaggagcgatagtgtctacttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagtgtctacgtcgacagatacgcagtattttggcccaggcacccggctgacagtgctcggtaagcgggggctcccgctgaagccccggaactggggagggggcgccccgggacgcgagcgatagtgtctacctgatggcgcgagggaggc

SEQ ID NO: 3205 - DNA, 495 bp, Artificial Sequence
  Oligonucleotide
gccttgccagcccgctcaggagcgatagtacagtgttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatagtacagtggtcgacaaaacattcagtacttcggcgccgggacccggctctcagtgctgggtaagctggggccgccgggggaccggggacgagactgcgctcgggtttttgtgcggagcgatagtacagtgctgatggcgcgagggaggc

SEQ ID NO: 3206 - DNA, 495 bp, Artificial Sequence
  Oligonucleotide
gccttgccagcccgctcaggagcgataggatcatcttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataggatcatcgtcgacgagacccagtacttcgggccaggcacgcggctcctggtgctcggtgagcgcgggctgctggggcgcgggcgcgggcggcttgggtctggtttttgcgggggagcgataggatcatcctgatggcgcgagggaggc

SEQ ID NO: 3207 - DNA, 495 bp, Artificial Sequence
  Oligonucleotide
gccttgccagcccgctcaggagcgatatattggcgttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgatatattggcggtcgacgggccaacgtcctgactttcggggccggcagcaggctgaccgtgctgggtgagttttcgcgggaccacccgggcggcgggattcaggtggaaggcggcgggagcgatatattggcgctgatggcgcgagggaggc

SEQ ID NO: 3208 - DNA, 495 bp, Artificial Sequence
  Oligonucleotide
gccttgccagcccgctcaggagcgataaggcttgattcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagtgagagcgataaggcttgagtcgacacgagcagtacttcgggccgggcaccaggctcacggtcacaggtgagattcgggcgtctccccaccttccagcccctcggtccccggagtcggagggtgggagcgataaggcttgactgatggcgcgagggaggc

SEQ ID NO: 3209 - DNA, 495 bp, Artificial Sequence
  Oligonucleotide
gccttgccagcccgctcaggcatctgagacactcttcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagacactctgtcgacactgaagctttctttggacaaggcaccagactcacagttgtaggtaagacatttttcaggttcttttgcagatccgtcacagggaaaagtgggtccacaggcatctgagacactctctgatggcgcgagggaggc

SEQ ID NO: 3210 - DNA, 495 bp, Artificial Sequence
  Oligonucleotide
gccttgccagcccgctcaggcatctgattcggaactcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgattcggaacgtcgactatggctacaccttcggttcggggaccaggttaaccgttgtaggtaaggctgggggtctctaggaggggtgcgatgagggaggactctgtcctgggaaatgcatctgattcggaacctgatggcgcgagggaggc

SEQ ID NO: 3211 - DNA, 495 bp, Artificial Sequence
  Oligonucleotide
gccttgccagcccgctcaggcatctgaaagtaacgtcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaaagtaacggtcgacgaaacaccatatattttggagagggaagttggctcactgttgtaggtgagtaagtcaaggctggacagctgggaacttgcaaaaaggggctggaatccaggcatctgaaagtaacgctgatggcgcgagggaggc

SEQ ID NO: 3212 - DNA, 495 bp, Artificial Sequence
  Oligonucleotide
gccttgccagcccgctcaggcatctgagtctcctatcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagtctcctagtcgacaatgaaaaactgttttttggcagtggaacccagctctctgtcttgggtatgtaaaagacttctttcgggatagtgtatcataaggtcggagttccaggaggcatctgagtctcctactgatggcgcgagggaggc

SEQ ID NO: 3213 - DNA, 495 bp, Artificial Sequence
  Oligonucleotide
gccttgccagcccgctcaggcatctgaagagtgtctcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaagagtgtcgtcgacatcagccccagcattttggtgatgggactcgactctccatcctaggtaagttgcagaatcagggtggtatggccattgtcccttgaaggcagagttctctgcatctgaagagtgtcctgatggcgcgagggaggc

SEQ ID NO: 3214 - DNA, 495 bp, Artificial Sequence
  Oligonucleotide
gccttgccagcccgctcaggcatctgagttccgaatcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagttccgaagtcgacataattcacccctccactttgggaacgggaccaggctcactgtgacaggtatgggggctccactcttgactcgggggtgcctgggtttgactgcaatgatgcatctgagttccgaactgatggcgcgagggaggc

SEQ ID NO: 3215 - DNA, 495 bp, Artificial Sequence
  Oligonucleotide
gccttgccagcccgctcaggcatctgacgttactttcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgacgttacttgtcgacacaatgagcagttcttcgggccagggacacggctcaccgtgctaggtaagaagggggctccaggtgggagagagggtgagcagcccagcctgcacgacccgcatctgacgttacttctgatggcgcgagggaggc

SEQ ID NO: 3216 - DNA, 495 bp, Artificial Sequence
  Oligonucleotide
gccttgccagcccgctcaggcatctgataggagactcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgataggagacgtcgacaccggggagctgttttttggagaaggctctaggctgaccgtactgggtaaggaggcggttggggctccggagagctccgagagggcgggatgggcagagggcatctgataggagacctgatggcgcgagggaggc

SEQ ID NO: 3217 - DNA, 495 bp, Artificial Sequence
  Oligonucleotide
gccttgccagcccgctcaggcatctgagtgtctactcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagtgtctacgtcgacagatacgcagtattttggcccaggcacccggctgacagtgctcggtaagcgggggctcccgctgaagccccggaactggggagggggcgccccgggacgcgcatctgagtgtctacctgatggcgcgagggaggc

SEQ ID NO: 3218 - DNA, 495 bp, Artificial Sequence
  Oligonucleotide
gccttgccagcccgctcaggcatctgagtacagtgtcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgagtacagtggtcgacaaaacattcagtacttcggcgccgggacccggctctcagtgctgggtaagctggggccgccgggggaccggggacgagactgcgctcgggtttttgtgcggcatctgagtacagtgctgatggcgcgagggaggc

SEQ ID NO: 3219 - DNA, 495 bp, Artificial Sequence
  Oligonucleotide
gccttgccagcccgctcaggcatctgaggatcatctcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaggatcatcgtcgacgagacccagtacttcgggccaggcacgcggctcctggtgctcggtgagcgcgggctgctggggcgcgggcgcgggcggcttgggtctggtttttgcgggggcatctgaggatcatcctgatggcgcgagggaggc

SEQ ID NO: 3220 - DNA, 495 bp, Artificial Sequence
  Oligonucleotide
gccttgccagcccgctcaggcatctgatattggcgtcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgatattggcggtcgacgggccaacgtcctgactttcggggccggcagcaggctgaccgtgctgggtgagttttcgcgggaccacccgggcggcgggattcaggtggaaggcggcgggcatctgatattggcgctgatggcgcgagggaggc

SEQ ID NO: 3221 - DNA, 495 bp, Artificial Sequence
  Oligonucleotide
gccttgccagcccgctcaggcatctgaaggcttgatcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagtgagcatctgaaggcttgagtcgacacgagcagtacttcgggccgggcaccaggctcacggtcacaggtgagattcgggcgtctccccaccttccagcccctcggtccccggagtcggagggtgggcatctgaaggcttgactgatggcgcgagggaggc

SEQ ID NO: 3222 - DNA, 495 bp, Artificial Sequence
  Oligonucleotide
gccttgccagcccgctcagtgctacacgacactcttccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgacactctgtcgacactgaagctttctttggacaaggcaccagactcacagttgtaggtaagacatttttcaggttcttttgcagatccgtcacagggaaaagtgggtccacagtgctacacgacactctctgatggcgcgagggaggc

SEQ ID NO: 3223 - DNA, 495 bp, Artificial Sequence
  Oligonucleotide
gccttgccagcccgctcagtgctacacttcggaactccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacttcggaacgtcgactatggctacaccttcggttcggggaccaggttaaccgttgtaggtaaggctgggggtctctaggaggggtgcgatgagggaggactctgtcctgggaaattgctacacttcggaacctgatggcgcgagggaggc

SEQ ID NO: 3224 - DNA, 495 bp, Artificial Sequence
  Oligonucleotide
gccttgccagcccgctcagtgctacacaagtaacgtccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacaagtaacggtcgacgaaacaccatatattttggagagggaagttggctcactgttgtaggtgagtaagtcaaggctggacagctgggaacttgcaaaaaggggctggaatccagtgctacacaagtaacgctgatggcgcgagggaggc

SEQ ID NO: 3225 - DNA, 495 bp, Artificial Sequence
  Oligonucleotide
gccttgccagcccgctcagtgctacacgtctcctatccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgtctcctagtcgacaatgaaaaactgttttttggcagtggaacccagctctctgtcttgggtatgtaaaagacttctttcgggatagtgtatcataaggtcggagttccaggagtgctacacgtctcctactgatggcgcgagggaggc

SEQ ID NO: 3226 - DNA, 495 bp, Artificial Sequence
  Oligonucleotide
gccttgccagcccgctcagtgctacacagagtgtctccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacagagtgtcgtcgacatcagccccagcattttggtgatgggactcgactctccatcctaggtaagttgcagaatcagggtggtatggccattgtcccttgaaggcagagttctcttgctacacagagtgtcctgatggcgcgagggaggc

SEQ ID NO: 3227 - DNA, 495 bp, Artificial Sequence
  Oligonucleotide
gccttgccagcccgctcagtgctacacgttccgaatccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgttccgaagtcgacataattcacccctccactttgggaacgggaccaggctcactgtgacaggtatgggggctccactcttgactcgggggtgcctgggtttgactgcaatgattgctacacgttccgaactgatggcgcgagggaggc

SEQ ID NO: 3228 - DNA, 495 bp, Artificial Sequence
  Oligonucleotide
gccttgccagcccgctcagtgctacaccgttactttccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacaccgttacttgtcgacacaatgagcagttcttcgggccagggacacggctcaccgtgctaggtaagaagggggctccaggtgggagagagggtgagcagcccagcctgcacgaccctgctacaccgttacttctgatggcgcgagggaggc

SEQ ID NO: 3229 - DNA, 495 bp, Artificial Sequence
  Oligonucleotide
gccttgccagcccgctcagtgctacactaggagactccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacactaggagacgtcgacaccggggagctgttttttggagaaggctctaggctgaccgtactgggtaaggaggcggttggggctccggagagctccgagagggcgggatgggcagaggtgctacactaggagacctgatggcgcgagggaggc

SEQ ID NO: 3230 - DNA, 495 bp, Artificial Sequence
  Oligonucleotide
gccttgccagcccgctcagtgctacacgtgtctactccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgtgtctacgtcgacagatacgcagtattttggcccaggcacccggctgacagtgctcggtaagcgggggctcccgctgaagccccggaactggggagggggcgccccgggacgctgctacacgtgtctacctgatggcgcgagggaggc

SEQ ID NO: 3231 - DNA, 495 bp, Artificial Sequence
  Oligonucleotide
gccttgccagcccgctcagtgctacacgtacagtgtccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacgtacagtggtcgacaaaacattcagtacttcggcgccgggacccggctctcagtgctgggtaagctggggccgccgggggaccggggacgagactgcgctcgggtttttgtgcgtgctacacgtacagtgctgatggcgcgagggaggc

SEQ ID NO: 3232 - DNA, 495 bp, Artificial Sequence
  Oligonucleotide
gccttgccagcccgctcagtgctacacggatcatctccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacggatcatcgtcgacgagacccagtacttcgggccaggcacgcggctcctggtgctcggtgagcgcgggctgctggggcgcgggcgcgggcggcttgggtctggtttttgcggggtgctacacggatcatcctgatggcgcgagggaggc

SEQ ID NO: 3233 - DNA, 495 bp, Artificial Sequence
  Oligonucleotide
gccttgccagcccgctcagtgctacactattggcgtccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacactattggcggtcgacgggccaacgtcctgactttcggggccggcagcaggctgaccgtgctgggtgagttttcgcgggaccacccgggcggcgggattcaggtggaaggcggcggtgctacactattggcgctgatggcgcgagggaggc

SEQ ID NO: 3234 - DNA, 495 bp, Artificial Sequence
  Oligonucleotide
gccttgccagcccgctcagtgctacacaggcttgatccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagtgatgctacacaggcttgagtcgacacgagcagtacttcgggccgggcaccaggctcacggtcacaggtgagattcgggcgtctccccaccttccagcccctcggtccccggagtcggagggtggtgctacacaggcttgactgatggcgcgagggaggc

SEQ ID NO: 3235 - DNA, 495 bp, Artificial Sequence
  Oligonucleotide
gccttgccagcccgctcagaactgccagacactcttccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagacactctgtcgacactgaagctttctttggacaaggcaccagactcacagttgtaggtaagacatttttcaggttcttttgcagatccgtcacagggaaaagtgggtccacagaactgccagacactctctgatggcgcgagggaggc

SEQ ID NO: 3236 - DNA, 495 bp, Artificial Sequence
  Oligonucleotide
gccttgccagcccgctcagaactgccattcggaactccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccattcggaacgtcgactatggctacaccttcggttcggggaccaggttaaccgttgtaggtaaggctgggggtctctaggaggggtgcgatgagggaggactctgtcctgggaaataactgccattcggaacctgatggcgcgagggaggc

SEQ ID NO: 3237 - DNA, 495 bp, Artificial Sequence
  Oligonucleotide
gccttgccagcccgctcagaactgccaaagtaacgtccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaaagtaacggtcgacgaaacaccatatattttggagagggaagttggctcactgttgtaggtgagtaagtcaaggctggacagctgggaacttgcaaaaaggggctggaatccagaactgccaaagtaacgctgatggcgcgagggaggc

SEQ ID NO: 3238 - DNA, 495 bp, Artificial Sequence
  Oligonucleotide
gccttgccagcccgctcagaactgccagtctcctatccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagtctcctagtcgacaatgaaaaactgttttttggcagtggaacccagctctctgtcttgggtatgtaaaagacttctttcgggatagtgtatcataaggtcggagttccaggagaactgccagtctcctactgatggcgcgagggaggc

SEQ ID NO: 3239 - DNA, 495 bp, Artificial Sequence
  Oligonucleotide
gccttgccagcccgctcagaactgccaagagtgtctccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaagagtgtcgtcgacatcagccccagcattttggtgatgggactcgactctccatcctaggtaagttgcagaatcagggtggtatggccattgtcccttgaaggcagagttctctaactgccaagagtgtcctgatggcgcgagggaggc

SEQ ID NO: 3240 - DNA, 495 bp, Artificial Sequence
  Oligonucleotide
gccttgccagcccgctcagaactgccagttccgaatccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagttccgaagtcgacataattcacccctccactttgggaacgggaccaggctcactgtgacaggtatgggggctccactcttgactcgggggtgcctgggtttgactgcaatgataactgccagttccgaactgatggcgcgagggaggc

SEQ ID NO: 3241 - DNA, 495 bp, Artificial Sequence
  Oligonucleotide
gccttgccagcccgctcagaactgccacgttactttccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccacgttacttgtcgacacaatgagcagttcttcgggccagggacacggctcaccgtgctaggtaagaagggggctccaggtgggagagagggtgagcagcccagcctgcacgacccaactgccacgttacttctgatggcgcgagggaggc

SEQ ID NO: 3242 - DNA, 495 bp, Artificial Sequence
  Oligonucleotide
gccttgccagcccgctcagaactgccataggagactccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccataggagacgtcgacaccggggagctgttttttggagaaggctctaggctgaccgtactgggtaaggaggcggttggggctccggagagctccgagagggcgggatgggcagaggaactgccataggagacctgatggcgcgagggaggc

SEQ ID NO: 3243 - DNA, 495 bp, Artificial Sequence
  Oligonucleotide
gccttgccagcccgctcagaactgccagtgtctactccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagtgtctacgtcgacagatacgcagtattttggcccaggcacccggctgacagtgctcggtaagcgggggctcccgctgaagccccggaactggggagggggcgccccgggacgcaactgccagtgtctacctgatggcgcgagggaggc

SEQ ID NO: 3244 - DNA, 495 bp, Artificial Sequence
  Oligonucleotide
gccttgccagcccgctcagaactgccagtacagtgtccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccagtacagtggtcgacaaaacattcagtacttcggcgccgggacccggctctcagtgctgggtaagctggggccgccgggggaccggggacgagactgcgctcgggtttttgtgcgaactgccagtacagtgctgatggcgcgagggaggc

SEQ ID NO: 3245 - DNA, 495 bp, Artificial Sequence
  Oligonucleotide
gccttgccagcccgctcagaactgccaggatcatctccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaggatcatcgtcgacgagacccagtacttcgggccaggcacgcggctcctggtgctcggtgagcgcgggctgctggggcgcgggcgcgggcggcttgggtctggtttttgcggggaactgccaggatcatcctgatggcgcgagggaggc

SEQ ID NO: 3246 - DNA, 495 bp, Artificial Sequence
  Oligonucleotide
gccttgccagcccgctcagaactgccatattggcgtccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccatattggcggtcgacgggccaacgtcctgactttcggggccggcagcaggctgaccgtgctgggtgagttttcgcgggaccacccgggcggcgggattcaggtggaaggcggcggaactgccatattggcgctgatggcgcgagggaggc

SEQ ID NO: 3247 - DNA, 495 bp, Artificial Sequence
  Oligonucleotide
gccttgccagcccgctcagaactgccaaggcttgatccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagtgaaactgccaaggcttgagtcgacacgagcagtacttcgggccgggcaccaggctcacggtcacaggtgagattcgggcgtctccccaccttccagcccctcggtccccggagtcggagggtggaactgccaaggcttgactgatggcgcgagggaggc

SEQ ID NO: 3248 - DNA, 495 bp, Artificial Sequence
  Oligonucleotide
gccttgccagcccgctcagttggactggacactctcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggacactctgtcgacactgaagctttctttggacaaggcaccagactcacagttgtaggtaagacatttttcaggttcttttgcagatccgtcacagggaaaagtgggtccacagttggactggacactctctgatggcgcgagggaggc

SEQ ID NO: 3249 - DNA, 495 bp, Artificial Sequence
  Oligonucleotide
gccttgccagcccgctcagttggactgttcggaaccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgttcggaacgtcgactatggctacaccttcggttcggggaccaggttaaccgttgtaggtaaggctgggggtctctaggaggggtgcgatgagggaggactctgtcctgggaaatttggactgttcggaacctgatggcgcgagggaggc

SEQ ID NO: 3250 - DNA, 495 bp, Artificial Sequence
  Oligonucleotide
gccttgccagcccgctcagttggactgaagtaacgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgaagtaacggtcgacgaaacaccatatattttggagagggaagttggctcactgttgtaggtgagtaagtcaaggctggacagctgggaacttgcaaaaaggggctggaatccagttggactgaagtaacgctgatggcgcgagggaggc

SEQ ID NO: 3251 - DNA, 495 bp, Artificial Sequence
  Oligonucleotide
gccttgccagcccgctcagttggactggtctcctacttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggtctcctagtcgacaatgaaaaactgttttttggcagtggaacccagctctctgtcttgggtatgtaaaagacttctttcgggatagtgtatcataaggtcggagttccaggagttggactggtctcctactgatggcgcgagggaggc

SEQ ID NO: 3252 - DNA, 495 bp, Artificial Sequence
  Oligonucleotide
gccttgccagcccgctcagttggactgagagtgtccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgagagtgtcgtcgacatcagccccagcattttggtgatgggactcgactctccatcctaggtaagttgcagaatcagggtggtatggccattgtcccttgaaggcagagttctctttggactgagagtgtcctgatggcgcgagggaggc

SEQ ID NO: 3253 - DNA, 495 bp, Artificial Sequence
  Oligonucleotide
gccttgccagcccgctcagttggactggttccgaacttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggttccgaagtcgacataattcacccctccactttgggaacgggaccaggctcactgtgacaggtatgggggctccactcttgactcgggggtgcctgggtttgactgcaatgatttggactggttccgaactgatggcgcgagggaggc

SEQ ID NO: 3254 - DNA, 495 bp, Artificial Sequence
  Oligonucleotide
gccttgccagcccgctcagttggactgcgttacttcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgcgttacttgtcgacacaatgagcagttcttcgggccagggacacggctcaccgtgctaggtaagaagggggctccaggtgggagagagggtgagcagcccagcctgcacgacccttggactgcgttacttctgatggcgcgagggaggc

SEQ ID NO: 3255 - DNA, 495 bp, Artificial Sequence
  Oligonucleotide
gccttgccagcccgctcagttggactgtaggagaccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgtaggagacgtcgacaccggggagctgttttttggagaaggctctaggctgaccgtactgggtaaggaggcggttggggctccggagagctccgagagggcgggatgggcagaggttggactgtaggagacctgatggcgcgagggaggc

SEQ ID NO: 3256 - DNA, 495 bp, Artificial Sequence
  Oligonucleotide
gccttgccagcccgctcagttggactggtgtctaccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggtgtctacgtcgacagatacgcagtattttggcccaggcacccggctgacagtgctcggtaagcgggggctcccgctgaagccccggaactggggagggggcgccccgggacgcttggactggtgtctacctgatggcgcgagggaggc

SEQ ID NO: 3257 - DNA, 495 bp, Artificial Sequence
  Oligonucleotide
gccttgccagcccgctcagttggactggtacagtgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactggtacagtggtcgacaaaacattcagtacttcggcgccgggacccggctctcagtgctgggtaagctggggccgccgggggaccggggacgagactgcgctcgggtttttgtgcgttggactggtacagtgctgatggcgcgagggaggc

SEQ ID NO: 3258 - DNA, 495 bp, Artificial Sequence
  Oligonucleotide
gccttgccagcccgctcagttggactgggatcatccttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgggatcatcgtcgacgagacccagtacttcgggccaggcacgcggctcctggtgctcggtgagcgcgggctgctggggcgcgggcgcgggcggcttgggtctggtttttgcggggttggactgggatcatcctgatggcgcgagggaggc

SEQ ID NO: 3259 - DNA, 495 bp, Artificial Sequence
  Oligonucleotide
gccttgccagcccgctcagttggactgtattggcgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgtattggcggtcgacgggccaacgtcctgactttcggggccggcagcaggctgaccgtgctgggtgagttttcgcgggaccacccgggcggcgggattcaggtggaaggcggcggttggactgtattggcgctgatggcgcgagggaggc

SEQ ID NO: 3260 - DNA, 495 bp, Artificial Sequence
  Oligonucleotide
gccttgccagcccgctcagttggactgaggcttgacttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcatgattggactgaggcttgagtcgacacgagcagtacttcgggccgggcaccaggctcacggtcacaggtgagattcgggcgtctccccaccttccagcccctcggtccccggagtcggagggtggttggactgaggcttgactgatggcgcgagggaggc

SEQ ID NO: 3261 - DNA, 495 bp, Artificial Sequence
  Oligonucleotide
gccttgccagcccgctcaggtagacacgacactctttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgacactctgtcgacactgaagctttctttggacaaggcaccagactcacagttgtaggtaagacatttttcaggttcttttgcagatccgtcacagggaaaagtgggtccacaggtagacacgacactctctgatggcgcgagggaggc

SEQ ID NO: 3262 - DNA, 495 bp, Artificial Sequence
  Oligonucleotide
gccttgccagcccgctcaggtagacacttcggaacttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacttcggaacgtcgactatggctacaccttcggttcggggaccaggttaaccgttgtaggtaaggctgggggtctctaggaggggtgcgatgagggaggactctgtcctgggaaatgtagacacttcggaacctgatggcgcgagggaggc

SEQ ID NO: 3263 - DNA, 495 bp, Artificial Sequence
  Oligonucleotide
gccttgccagcccgctcaggtagacacaagtaacgttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacaagtaacggtcgacgaaacaccatatattttggagagggaagttggctcactgttgtaggtgagtaagtcaaggctggacagctgggaacttgcaaaaaggggctggaatccaggtagacacaagtaacgctgatggcgcgagggaggc

SEQ ID NO: 3264 - DNA, 495 bp, Artificial Sequence
  Oligonucleotide
gccttgccagcccgctcaggtagacacgtctcctattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgtctcctagtcgacaatgaaaaactgttttttggcagtggaacccagctctctgtcttgggtatgtaaaagacttctttcgggatagtgtatcataaggtcggagttccaggaggtagacacgtctcctactgatggcgcgagggaggc

SEQ ID NO: 3265 - DNA, 495 bp, Artificial Sequence
  Oligonucleotide
gccttgccagcccgctcaggtagacacagagtgtcttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacagagtgtcgtcgacatcagccccagcattttggtgatgggactcgactctccatcctaggtaagttgcagaatcagggtggtatggccattgtcccttgaaggcagagttctctgtagacacagagtgtcctgatggcgcgagggaggc

SEQ ID NO: 3266 - DNA, 495 bp, Artificial Sequence
  Oligonucleotide
gccttgccagcccgctcaggtagacacgttccgaattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgttccgaagtcgacataattcacccctccactttgggaacgggaccaggctcactgtgacaggtatgggggctccactcttgactcgggggtgcctgggtttgactgcaatgatgtagacacgttccgaactgatggcgcgagggaggc

SEQ ID NO: 3267 - DNA, 495 bp, Artificial Sequence
  Oligonucleotide
gccttgccagcccgctcaggtagacaccgttacttttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacaccgttacttgtcgacacaatgagcagttcttcgggccagggacacggctcaccgtgctaggtaagaagggggctccaggtgggagagagggtgagcagcccagcctgcacgacccgtagacaccgttacttctgatggcgcgagggaggc

SEQ ID NO: 3268 - DNA, 495 bp, Artificial Sequence
  Oligonucleotide
gccttgccagcccgctcaggtagacactaggagacttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacactaggagacgtcgacaccggggagctgttttttggagaaggctctaggctgaccgtactgggtaaggaggcggttggggctccggagagctccgagagggcgggatgggcagagggtagacactaggagacctgatggcgcgagggaggc

SEQ ID NO: 3269 - DNA, 495 bp, Artificial Sequence
  Oligonucleotide
gccttgccagcccgctcaggtagacacgtgtctacttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgtgtctacgtcgacagatacgcagtattttggcccaggcacccggctgacagtgctcggtaagcgggggctcccgctgaagccccggaactggggagggggcgccccgggacgcgtagacacgtgtctacctgatggcgcgagggaggc

SEQ ID NO: 3270 - DNA, 495 bp, Artificial Sequence
  Oligonucleotide
gccttgccagcccgctcaggtagacacgtacagtgttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacgtacagtggtcgacaaaacattcagtacttcggcgccgggacccggctctcagtgctgggtaagctggggccgccgggggaccggggacgagactgcgctcgggtttttgtgcggtagacacgtacagtgctgatggcgcgagggaggc

SEQ ID NO: 3271 - DNA, 495 bp, Artificial Sequence
  Oligonucleotide
gccttgccagcccgctcaggtagacacggatcatcttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacggatcatcgtcgacgagacccagtacttcgggccaggcacgcggctcctggtgctcggtgagcgcgggctgctggggcgcgggcgcgggcggcttgggtctggtttttgcgggggtagacacggatcatcctgatggcgcgagggaggc

SEQ ID NO: 3272 - DNA, 495 bp, Artificial Sequence
  Oligonucleotide
gccttgccagcccgctcaggtagacactattggcgttctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacactattggcggtcgacgggccaacgtcctgactttcggggccggcagcaggctgaccgtgctgggtgagttttcgcgggaccacccgggcggcgggattcaggtggaaggcggcgggtagacactattggcgctgatggcgcgagggaggc

SEQ ID NO: 3273 - DNA, 495 bp, Artificial Sequence
  Oligonucleotide
gccttgccagcccgctcaggtagacacaggcttgattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcatgagtagacacaggcttgagtcgacacgagcagtacttcgggccgggcaccaggctcacggtcacaggtgagattcgggcgtctccccaccttccagcccctcggtccccggagtcggagggtgggtagacacaggcttgactgatggcgcgagggaggc

SEQ ID NO: 3274 - DNA, 495 bp, Artificial Sequence
  Oligonucleotide
gccttgccagcccgctcagcactgtacgacactctcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgacactctgtcgacactgaagctttctttggacaaggcaccagactcacagttgtaggtaagacatttttcaggttcttttgcagatccgtcacagggaaaagtgggtccacagcactgtacgacactctctgatggcgcgagggaggc

SEQ ID NO: 3275 - DNA, 495 bp, Artificial Sequence
  Oligonucleotide
gccttgccagcccgctcagcactgtacttcggaaccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacttcggaacgtcgactatggctacaccttcggttcggggaccaggttaaccgttgtaggtaaggctgggggtctctaggaggggtgcgatgagggaggactctgtcctgggaaatcactgtacttcggaacctgatggcgcgagggaggc

SEQ ID NO: 3276 - DNA, 495 bp, Artificial Sequence
  Oligonucleotide
gccttgccagcccgctcagcactgtacaagtaacgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacaagtaacggtcgacgaaacaccatatattttggagagggaagttggctcactgttgtaggtgagtaagtcaaggctggacagctgggaacttgcaaaaaggggctggaatccagcactgtacaagtaacgctgatggcgcgagggaggc

SEQ ID NO: 3277 - DNA, 495 bp, Artificial Sequence
  Oligonucleotide
gccttgccagcccgctcagcactgtacgtctcctacttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgtctcctagtcgacaatgaaaaactgttttttggcagtggaacccagctctctgtcttgggtatgtaaaagacttctttcgggatagtgtatcataaggtcggagttccaggagcactgtacgtctcctactgatggcgcgagggaggc

SEQ ID NO: 3278 - DNA, 495 bp, Artificial Sequence
  Oligonucleotide
gccttgccagcccgctcagcactgtacagagtgtccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacagagtgtcgtcgacatcagccccagcattttggtgatgggactcgactctccatcctaggtaagttgcagaatcagggtggtatggccattgtcccttgaaggcagagttctctcactgtacagagtgtcctgatggcgcgagggaggc

SEQ ID NO: 3279 - DNA, 495 bp, Artificial Sequence
  Oligonucleotide
gccttgccagcccgctcagcactgtacgttccgaacttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgttccgaagtcgacataattcacccctccactttgggaacgggaccaggctcactgtgacaggtatgggggctccactcttgactcgggggtgcctgggtttgactgcaatgatcactgtacgttccgaactgatggcgcgagggaggc

SEQ ID NO: 3280 - DNA, 495 bp, Artificial Sequence
  Oligonucleotide
gccttgccagcccgctcagcactgtaccgttacttcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtaccgttacttgtcgacacaatgagcagttcttcgggccagggacacggctcaccgtgctaggtaagaagggggctccaggtgggagagagggtgagcagcccagcctgcacgaccccactgtaccgttacttctgatggcgcgagggaggc

SEQ ID NO: 3281 - DNA, 495 bp, Artificial Sequence
  Oligonucleotide
gccttgccagcccgctcagcactgtactaggagaccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtactaggagacgtcgacaccggggagctgttttttggagaaggctctaggctgaccgtactgggtaaggaggcggttggggctccggagagctccgagagggcgggatgggcagaggcactgtactaggagacctgatggcgcgagggaggc

SEQ ID NO: 3282 - DNA, 495 bp, Artificial Sequence
  Oligonucleotide
gccttgccagcccgctcagcactgtacgtgtctaccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgtgtctacgtcgacagatacgcagtattttggcccaggcacccggctgacagtgctcggtaagcgggggctcccgctgaagccccggaactggggagggggcgccccgggacgccactgtacgtgtctacctgatggcgcgagggaggc

SEQ ID NO: 3283 - DNA, 495 bp, Artificial Sequence
  Oligonucleotide
gccttgccagcccgctcagcactgtacgtacagtgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacgtacagtggtcgacaaaacattcagtacttcggcgccgggacccggctctcagtgctgggtaagctggggccgccgggggaccggggacgagactgcgctcgggtttttgtgcgcactgtacgtacagtgctgatggcgcgagggaggc

SEQ ID NO: 3284 - DNA, 495 bp, Artificial Sequence
  Oligonucleotide
gccttgccagcccgctcagcactgtacggatcatccttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacggatcatcgtcgacgagacccagtacttcgggccaggcacgcggctcctggtgctcggtgagcgcgggctgctggggcgcgggcgcgggcggcttgggtctggtttttgcggggcactgtacggatcatcctgatggcgcgagggaggc

SEQ ID NO: 3285 - DNA, 495 bp, Artificial Sequence
  Oligonucleotide
gccttgccagcccgctcagcactgtactattggcgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtactattggcggtcgacgggccaacgtcctgactttcggggccggcagcaggctgaccgtgctgggtgagttttcgcgggaccacccgggcggcgggattcaggtggaaggcggcggcactgtactattggcgctgatggcgcgagggaggc

SEQ ID NO: 3286 - DNA, 495 bp, Artificial Sequence
  Oligonucleotide
gccttgccagcccgctcagcactgtacaggcttgacttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaatgacactgtacaggcttgagtcgacacgagcagtacttcgggccgggcaccaggctcacggtcacaggtgagattcgggcgtctccccaccttccagcccctcggtccccggagtcggagggtggcactgtacaggcttgactgatggcgcgagggaggc

SEQ ID NO: 3287 - DNA, 495 bp, Artificial Sequence
  Oligonucleotide
gccttgccagcccgctcaggatgatccgacactctcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgacactctgtcgacactgaagctttctttggacaaggcaccagactcacagttgtaggtaagacatttttcaggttcttttgcagatccgtcacagggaaaagtgggtccacaggatgatccgacactctctgatggcgcgagggaggc

SEQ ID NO: 3288 - DNA, 495 bp, Artificial Sequence
  Oligonucleotide
gccttgccagcccgctcaggatgatccttcggaaccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccttcggaacgtcgactatggctacaccttcggttcggggaccaggttaaccgttgtaggtaaggctgggggtctctaggaggggtgcgatgagggaggactctgtcctgggaaatgatgatccttcggaacctgatggcgcgagggaggc

SEQ ID NO: 3289 - DNA, 495 bp, Artificial Sequence
  Oligonucleotide
gccttgccagcccgctcaggatgatccaagtaacgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccaagtaacggtcgacgaaacaccatatattttggagagggaagttggctcactgttgtaggtgagtaagtcaaggctggacagctgggaacttgcaaaaaggggctggaatccaggatgatccaagtaacgctgatggcgcgagggaggc

SEQ ID NO: 3290 - DNA, 495 bp, Artificial Sequence
  Oligonucleotide
gccttgccagcccgctcaggatgatccgtctcctacttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgtctcctagtcgacaatgaaaaactgttttttggcagtggaacccagctctctgtcttgggtatgtaaaagacttctttcgggatagtgtatcataaggtcggagttccaggaggatgatccgtctcctactgatggcgcgagggaggc

SEQ ID NO: 3291 - DNA, 495 bp, Artificial Sequence
  Oligonucleotide
gccttgccagcccgctcaggatgatccagagtgtccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccagagtgtcgtcgacatcagccccagcattttggtgatgggactcgactctccatcctaggtaagttgcagaatcagggtggtatggccattgtcccttgaaggcagagttctctgatgatccagagtgtcctgatggcgcgagggaggc

SEQ ID NO: 3292 - DNA, 495 bp, Artificial Sequence
  Oligonucleotide
gccttgccagcccgctcaggatgatccgttccgaacttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgttccgaagtcgacataattcacccctccactttgggaacgggaccaggctcactgtgacaggtatgggggctccactcttgactcgggggtgcctgggtttgactgcaatgatgatgatccgttccgaactgatggcgcgagggaggc

SEQ ID NO: 3293 - DNA, 495 bp, Artificial Sequence
  Oligonucleotide
gccttgccagcccgctcaggatgatcccgttacttcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatcccgttacttgtcgacacaatgagcagttcttcgggccagggacacggctcaccgtgctaggtaagaagggggctccaggtgggagagagggtgagcagcccagcctgcacgacccgatgatcccgttacttctgatggcgcgagggaggc

SEQ ID NO: 3294 - DNA, 495 bp, Artificial Sequence
  Oligonucleotide
gccttgccagcccgctcaggatgatcctaggagaccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatcctaggagacgtcgacaccggggagctgttttttggagaaggctctaggctgaccgtactgggtaaggaggcggttggggctccggagagctccgagagggcgggatgggcagagggatgatcctaggagacctgatggcgcgagggaggc

SEQ ID NO: 3295 - DNA, 495 bp, Artificial Sequence
  Oligonucleotide
gccttgccagcccgctcaggatgatccgtgtctaccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgtgtctacgtcgacagatacgcagtattttggcccaggcacccggctgacagtgctcggtaagcgggggctcccgctgaagccccggaactggggagggggcgccccgggacgcgatgatccgtgtctacctgatggcgcgagggaggc

SEQ ID NO: 3296 - DNA, 495 bp, Artificial Sequence
  Oligonucleotide
gccttgccagcccgctcaggatgatccgtacagtgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccgtacagtggtcgacaaaacattcagtacttcggcgccgggacccggctctcagtgctgggtaagctggggccgccgggggaccggggacgagactgcgctcgggtttttgtgcggatgatccgtacagtgctgatggcgcgagggaggc

SEQ ID NO: 3297 - DNA, 495 bp, Artificial Sequence
  Oligonucleotide
gccttgccagcccgctcaggatgatccggatcatccttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccggatcatcgtcgacgagacccagtacttcgggccaggcacgcggctcctggtgctcggtgagcgcgggctgctggggcgcgggcgcgggcggcttgggtctggtttttgcgggggatgatccggatcatcctgatggcgcgagggaggc

SEQ ID NO: 3298 - DNA, 495 bp, Artificial Sequence
  Oligonucleotide
gccttgccagcccgctcaggatgatcctattggcgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatcctattggcggtcgacgggccaacgtcctgactttcggggccggcagcaggctgaccgtgctgggtgagttttcgcgggaccacccgggcggcgggattcaggtggaaggcggcgggatgatcctattggcgctgatggcgcgagggaggc

SEQ ID NO: 3299 - DNA, 495 bp, Artificial Sequence
  Oligonucleotide
gccttgccagcccgctcaggatgatccaggcttgacttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcatgagatgatccaggcttgagtcgacacgagcagtacttcgggccgggcaccaggctcacggtcacaggtgagattcgggcgtctccccaccttccagcccctcggtccccggagtcggagggtgggatgatccaggcttgactgatggcgcgagggaggc

SEQ ID NO: 3300 - DNA, 495 bp, Artificial Sequence
  Oligonucleotide
gccttgccagcccgctcagcgccaatagacactctcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagacactctgtcgacactgaagctttctttggacaaggcaccagactcacagttgtaggtaagacatttttcaggttcttttgcagatccgtcacagggaaaagtgggtccacagcgccaatagacactctctgatggcgcgagggaggc

SEQ ID NO: 3301 - DNA, 495 bp, Artificial Sequence
  Oligonucleotide
gccttgccagcccgctcagcgccaatattcggaaccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatattcggaacgtcgactatggctacaccttcggttcggggaccaggttaaccgttgtaggtaaggctgggggtctctaggaggggtgcgatgagggaggactctgtcctgggaaatcgccaatattcggaacctgatggcgcgagggaggc

SEQ ID NO: 3302 - DNA, 495 bp, Artificial Sequence
  Oligonucleotide
gccttgccagcccgctcagcgccaataaagtaacgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataaagtaacggtcgacgaaacaccatatattttggagagggaagttggctcactgttgtaggtgagtaagtcaaggctggacagctgggaacttgcaaaaaggggctggaatccagcgccaataaagtaacgctgatggcgcgagggaggc

SEQ ID NO: 3303 - DNA, 495 bp, Artificial Sequence
  Oligonucleotide
gccttgccagcccgctcagcgccaatagtctcctacttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagtctcctagtcgacaatgaaaaactgttttttggcagtggaacccagctctctgtcttgggtatgtaaaagacttctttcgggatagtgtatcataaggtcggagttccaggagcgccaatagtctcctactgatggcgcgagggaggc

SEQ ID NO: 3304 - DNA, 495 bp, Artificial Sequence
  Oligonucleotide
gccttgccagcccgctcagcgccaataagagtgtccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataagagtgtcgtcgacatcagccccagcattttggtgatgggactcgactctccatcctaggtaagttgcagaatcagggtggtatggccattgtcccttgaaggcagagttctctcgccaataagagtgtcctgatggcgcgagggaggc

SEQ ID NO: 3305 - DNA, 495 bp, Artificial Sequence
  Oligonucleotide
gccttgccagcccgctcagcgccaatagttccgaacttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagttccgaagtcgacataattcacccctccactttgggaacgggaccaggctcactgtgacaggtatgggggctccactcttgactcgggggtgcctgggtttgactgcaatgatcgccaatagttccgaactgatggcgcgagggaggc

SEQ ID NO: 3306 - DNA, 495 bp, Artificial Sequence
  Oligonucleotide
gccttgccagcccgctcagcgccaatacgttacttcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatacgttacttgtcgacacaatgagcagttcttcgggccagggacacggctcaccgtgctaggtaagaagggggctccaggtgggagagagggtgagcagcccagcctgcacgaccccgccaatacgttacttctgatggcgcgagggaggc

SEQ ID NO: 3307 - DNA, 495 bp, Artificial Sequence
  Oligonucleotide
gccttgccagcccgctcagcgccaatataggagaccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatataggagacgtcgacaccggggagctgttttttggagaaggctctaggctgaccgtactgggtaaggaggcggttggggctccggagagctccgagagggcgggatgggcagaggcgccaatataggagacctgatggcgcgagggaggc

SEQ ID NO: 3308 - DNA, 495 bp, Artificial Sequence
  Oligonucleotide
gccttgccagcccgctcagcgccaatagtgtctaccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagtgtctacgtcgacagatacgcagtattttggcccaggcacccggctgacagtgctcggtaagcgggggctcccgctgaagccccggaactggggagggggcgccccgggacgccgccaatagtgtctacctgatggcgcgagggaggc

SEQ ID NO: 3309 - DNA, 495 bp, Artificial Sequence
  Oligonucleotide
gccttgccagcccgctcagcgccaatagtacagtgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatagtacagtggtcgacaaaacattcagtacttcggcgccgggacccggctctcagtgctgggtaagctggggccgccgggggaccggggacgagactgcgctcgggtttttgtgcgcgccaatagtacagtgctgatggcgcgagggaggc

SEQ ID NO: 3310 - DNA, 495 bp, Artificial Sequence
  Oligonucleotide
gccttgccagcccgctcagcgccaataggatcatccttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataggatcatcgtcgacgagacccagtacttcgggccaggcacgcggctcctggtgctcggtgagcgcgggctgctggggcgcgggcgcgggcggcttgggtctggtttttgcggggcgccaataggatcatcctgatggcgcgagggaggc

SEQ ID NO: 3311 - DNA, 495 bp, Artificial Sequence
  Oligonucleotide
gccttgccagcccgctcagcgccaatatattggcgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaatatattggcggtcgacgggccaacgtcctgactttcggggccggcagcaggctgaccgtgctgggtgagttttcgcgggaccacccgggcggcgggattcaggtggaaggcggcggcgccaatatattggcgctgatggcgcgagggaggc

SEQ ID NO: 3312 - DNA, 495 bp, Artificial Sequence
  Oligonucleotide
gccttgccagcccgctcagcgccaataaggcttgacttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcatgacgccaataaggcttgagtcgacacgagcagtacttcgggccgggcaccaggctcacggtcacaggtgagattcgggcgtctccccaccttccagcccctcggtccccggagtcggagggtggcgccaataaggcttgactgatggcgcgagggaggc

SEQ ID NO: 3313 - DNA, 495 bp, Artificial Sequence
  Oligonucleotide
gccttgccagcccgctcagtcaagcctgacactctcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgacactctgtcgacactgaagctttctttggacaaggcaccagactcacagttgtaggtaagacatttttcaggttcttttgcagatccgtcacagggaaaagtgggtccacagtcaagcctgacactctctgatggcgcgagggaggc

SEQ ID NO: 3314 - DNA, 495 bp, Artificial Sequence
  Oligonucleotide
gccttgccagcccgctcagtcaagcctttcggaaccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctttcggaacgtcgactatggctacaccttcggttcggggaccaggttaaccgttgtaggtaaggctgggggtctctaggaggggtgcgatgagggaggactctgtcctgggaaattcaagcctttcggaacctgatggcgcgagggaggc

SEQ ID NO: 3315 - DNA, 495 bp, Artificial Sequence
  Oligonucleotide
gccttgccagcccgctcagtcaagcctaagtaacgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctaagtaacggtcgacgaaacaccatatattttggagagggaagttggctcactgttgtaggtgagtaagtcaaggctggacagctgggaacttgcaaaaaggggctggaatccagtcaagcctaagtaacgctgatggcgcgagggaggc

SEQ ID NO: 3316 - DNA, 495 bp, Artificial Sequence
  Oligonucleotide
gccttgccagcccgctcagtcaagcctgtctcctacttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgtctcctagtcgacaatgaaaaactgttttttggcagtggaacccagctctctgtcttgggtatgtaaaagacttctttcgggatagtgtatcataaggtcggagttccaggagtcaagcctgtctcctactgatggcgcgagggaggc

SEQ ID NO: 3317 - DNA, 495 bp, Artificial Sequence
  Oligonucleotide
gccttgccagcccgctcagtcaagcctagagtgtccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctagagtgtcgtcgacatcagccccagcattttggtgatgggactcgactctccatcctaggtaagttgcagaatcagggtggtatggccattgtcccttgaaggcagagttctcttcaagcctagagtgtcctgatggcgcgagggaggc

SEQ ID NO: 3318 - DNA, 495 bp, Artificial Sequence
  Oligonucleotide
gccttgccagcccgctcagtcaagcctgttccgaacttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgttccgaagtcgacataattcacccctccactttgggaacgggaccaggctcactgtgacaggtatgggggctccactcttgactcgggggtgcctgggtttgactgcaatgattcaagcctgttccgaactgatggcgcgagggaggc

SEQ ID NO: 3319 - DNA, 495 bp, Artificial Sequence
  Oligonucleotide
gccttgccagcccgctcagtcaagcctcgttacttcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctcgttacttgtcgacacaatgagcagttcttcgggccagggacacggctcaccgtgctaggtaagaagggggctccaggtgggagagagggtgagcagcccagcctgcacgaccctcaagcctcgttacttctgatggcgcgagggaggc

SEQ ID NO: 3320 - DNA, 495 bp, Artificial Sequence
  Oligonucleotide
gccttgccagcccgctcagtcaagccttaggagaccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagccttaggagacgtcgacaccggggagctgttttttggagaaggctctaggctgaccgtactgggtaaggaggcggttggggctccggagagctccgagagggcgggatgggcagaggtcaagccttaggagacctgatggcgcgagggaggc

SEQ ID NO: 3321 - DNA, 495 bp, Artificial Sequence
  Oligonucleotide
gccttgccagcccgctcagtcaagcctgtgtctaccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgtgtctacgtcgacagatacgcagtattttggcccaggcacccggctgacagtgctcggtaagcgggggctcccgctgaagccccggaactggggagggggcgccccgggacgctcaagcctgtgtctacctgatggcgcgagggaggc

SEQ ID NO: 3322 - DNA, 495 bp, Artificial Sequence
  Oligonucleotide
gccttgccagcccgctcagtcaagcctgtacagtgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctgtacagtggtcgacaaaacattcagtacttcggcgccgggacccggctctcagtgctgggtaagctggggccgccgggggaccggggacgagactgcgctcgggtttttgtgcgtcaagcctgtacagtgctgatggcgcgagggaggc

SEQ ID NO: 3323 - DNA, 495 bp, Artificial Sequence
  Oligonucleotide
gccttgccagcccgctcagtcaagcctggatcatccttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctggatcatcgtcgacgagacccagtacttcgggccaggcacgcggctcctggtgctcggtgagcgcgggctgctggggcgcgggcgcgggcggcttgggtctggtttttgcggggtcaagcctggatcatcctgatggcgcgagggaggc

SEQ ID NO: 3324 - DNA, 495 bp, Artificial Sequence
  Oligonucleotide
gccttgccagcccgctcagtcaagccttattggcgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagccttattggcggtcgacgggccaacgtcctgactttcggggccggcagcaggctgaccgtgctgggtgagttttcgcgggaccacccgggcggcgggattcaggtggaaggcggcggtcaagccttattggcgctgatggcgcgagggaggc

SEQ ID NO: 3325 - DNA, 495 bp, Artificial Sequence
  Oligonucleotide
gccttgccagcccgctcagtcaagcctaggcttgacttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcatgatcaagcctaggcttgagtcgacacgagcagtacttcgggccgggcaccaggctcacggtcacaggtgagattcgggcgtctccccaccttccagcccctcggtccccggagtcggagggtggtcaagcctaggcttgactgatggcgcgagggaggc

SEQ ID NO: 3326 - DNA, 495 bp, Artificial Sequence
  Oligonucleotide
gccttgccagcccgctcagacgtgtgtgacactctcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgacactctgtcgacactgaagctttctttggacaaggcaccagactcacagttgtaggtaagacatttttcaggttcttttgcagatccgtcacagggaaaagtgggtccacagacgtgtgtgacactctctgatggcgcgagggaggc

SEQ ID NO: 3327 - DNA, 495 bp, Artificial Sequence
  Oligonucleotide
gccttgccagcccgctcagacgtgtgtttcggaaccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtttcggaacgtcgactatggctacaccttcggttcggggaccaggttaaccgttgtaggtaaggctgggggtctctaggaggggtgcgatgagggaggactctgtcctgggaaatacgtgtgtttcggaacctgatggcgcgagggaggc

SEQ ID NO: 3328 - DNA, 495 bp, Artificial Sequence
  Oligonucleotide
gccttgccagcccgctcagacgtgtgtaagtaacgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtaagtaacggtcgacgaaacaccatatattttggagagggaagttggctcactgttgtaggtgagtaagtcaaggctggacagctgggaacttgcaaaaaggggctggaatccagacgtgtgtaagtaacgctgatggcgcgagggaggc

SEQ ID NO: 3329 - DNA, 495 bp, Artificial Sequence
  Oligonucleotide
gccttgccagcccgctcagacgtgtgtgtctcctacttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgtctcctagtcgacaatgaaaaactgttttttggcagtggaacccagctctctgtcttgggtatgtaaaagacttctttcgggatagtgtatcataaggtcggagttccaggagacgtgtgtgtctcctactgatggcgcgagggaggc

SEQ ID NO: 3330 - DNA, 495 bp, Artificial Sequence
  Oligonucleotide
gccttgccagcccgctcagacgtgtgtagagtgtccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtagagtgtcgtcgacatcagccccagcattttggtgatgggactcgactctccatcctaggtaagttgcagaatcagggtggtatggccattgtcccttgaaggcagagttctctacgtgtgtagagtgtcctgatggcgcgagggaggc

SEQ ID NO: 3331 - DNA, 495 bp, Artificial Sequence
  Oligonucleotide
gccttgccagcccgctcagacgtgtgtgttccgaacttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgttccgaagtcgacataattcacccctccactttgggaacgggaccaggctcactgtgacaggtatgggggctccactcttgactcgggggtgcctgggtttgactgcaatgatacgtgtgtgttccgaactgatggcgcgagggaggc

SEQ ID NO: 3332 - DNA, 495 bp, Artificial Sequence
  Oligonucleotide
gccttgccagcccgctcagacgtgtgtcgttacttcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtcgttacttgtcgacacaatgagcagttcttcgggccagggacacggctcaccgtgctaggtaagaagggggctccaggtgggagagagggtgagcagcccagcctgcacgacccacgtgtgtcgttacttctgatggcgcgagggaggc

SEQ ID NO: 3333 - DNA, 495 bp, Artificial Sequence
  Oligonucleotide
gccttgccagcccgctcagacgtgtgttaggagaccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgttaggagacgtcgacaccggggagctgttttttggagaaggctctaggctgaccgtactgggtaaggaggcggttggggctccggagagctccgagagggcgggatgggcagaggacgtgtgttaggagacctgatggcgcgagggaggc

SEQ ID NO: 3334 - DNA, 495 bp, Artificial Sequence
  Oligonucleotide
gccttgccagcccgctcagacgtgtgtgtgtctaccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgtgtctacgtcgacagatacgcagtattttggcccaggcacccggctgacagtgctcggtaagcgggggctcccgctgaagccccggaactggggagggggcgccccgggacgcacgtgtgtgtgtctacctgatggcgcgagggaggc

SEQ ID NO: 3335 - DNA, 495 bp, Artificial Sequence
  Oligonucleotide
gccttgccagcccgctcagacgtgtgtgtacagtgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtgtacagtggtcgacaaaacattcagtacttcggcgccgggacccggctctcagtgctgggtaagctggggccgccgggggaccggggacgagactgcgctcgggtttttgtgcgacgtgtgtgtacagtgctgatggcgcgagggaggc

SEQ ID NO: 3336 - DNA, 495 bp, Artificial Sequence
  Oligonucleotide
gccttgccagcccgctcagacgtgtgtggatcatccttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtggatcatcgtcgacgagacccagtacttcgggccaggcacgcggctcctggtgctcggtgagcgcgggctgctggggcgcgggcgcgggcggcttgggtctggtttttgcggggacgtgtgtggatcatcctgatggcgcgagggaggc

SEQ ID NO: 3337 - DNA, 495 bp, Artificial Sequence
  Oligonucleotide
gccttgccagcccgctcagacgtgtgttattggcgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgttattggcggtcgacgggccaacgtcctgactttcggggccggcagcaggctgaccgtgctgggtgagttttcgcgggaccacccgggcggcgggattcaggtggaaggcggcggacgtgtgttattggcgctgatggcgcgagggaggc

SEQ ID NO: 3338 - DNA, 495 bp, Artificial Sequence
  Oligonucleotide
gccttgccagcccgctcagacgtgtgtaggcttgacttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcatgaacgtgtgtaggcttgagtcgacacgagcagtacttcgggccgggcaccaggctcacggtcacaggtgagattcgggcgtctccccaccttccagcccctcggtccccggagtcggagggtggacgtgtgtaggcttgactgatggcgcgagggaggc

SEQ ID NO: 3339 - DNA, 495 bp, Artificial Sequence
  Oligonucleotide
gccttgccagcccgctcagtccgtctagacactctcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagacactctgtcgacactgaagctttctttggacaaggcaccagactcacagttgtaggtaagacatttttcaggttcttttgcagatccgtcacagggaaaagtgggtccacagtccgtctagacactctctgatggcgcgagggaggc

SEQ ID NO: 3340 - DNA, 495 bp, Artificial Sequence
  Oligonucleotide
gccttgccagcccgctcagtccgtctattcggaaccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctattcggaacgtcgactatggctacaccttcggttcggggaccaggttaaccgttgtaggtaaggctgggggtctctaggaggggtgcgatgagggaggactctgtcctgggaaattccgtctattcggaacctgatggcgcgagggaggc

SEQ ID NO: 3341 - DNA, 495 bp, Artificial Sequence
  Oligonucleotide
gccttgccagcccgctcagtccgtctaaagtaacgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaaagtaacggtcgacgaaacaccatatattttggagagggaagttggctcactgttgtaggtgagtaagtcaaggctggacagctgggaacttgcaaaaaggggctggaatccagtccgtctaaagtaacgctgatggcgcgagggaggc

SEQ ID NO: 3342 - DNA, 495 bp, Artificial Sequence
  Oligonucleotide
gccttgccagcccgctcagtccgtctagtctcctacttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagtctcctagtcgacaatgaaaaactgttttttggcagtggaacccagctctctgtcttgggtatgtaaaagacttctttcgggatagtgtatcataaggtcggagttccaggagtccgtctagtctcctactgatggcgcgagggaggc

SEQ ID NO: 3343 - DNA, 495 bp, Artificial Sequence
  Oligonucleotide
gccttgccagcccgctcagtccgtctaagagtgtccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaagagtgtcgtcgacatcagccccagcattttggtgatgggactcgactctccatcctaggtaagttgcagaatcagggtggtatggccattgtcccttgaaggcagagttctcttccgtctaagagtgtcctgatggcgcgagggaggc

SEQ ID NO: 3344 - DNA, 495 bp, Artificial Sequence
  Oligonucleotide
gccttgccagcccgctcagtccgtctagttccgaacttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagttccgaagtcgacataattcacccctccactttgggaacgggaccaggctcactgtgacaggtatgggggctccactcttgactcgggggtgcctgggtttgactgcaatgattccgtctagttccgaactgatggcgcgagggaggc

SEQ ID NO: 3345 - DNA, 495 bp, Artificial Sequence
  Oligonucleotide
gccttgccagcccgctcagtccgtctacgttacttcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctacgttacttgtcgacacaatgagcagttcttcgggccagggacacggctcaccgtgctaggtaagaagggggctccaggtgggagagagggtgagcagcccagcctgcacgaccctccgtctacgttacttctgatggcgcgagggaggc

SEQ ID NO: 3346 - DNA, 495 bp, Artificial Sequence
  Oligonucleotide
gccttgccagcccgctcagtccgtctataggagaccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctataggagacgtcgacaccggggagctgttttttggagaaggctctaggctgaccgtactgggtaaggaggcggttggggctccggagagctccgagagggcgggatgggcagaggtccgtctataggagacctgatggcgcgagggaggc

SEQ ID NO: 3347 - DNA, 495 bp, Artificial Sequence
  Oligonucleotide
gccttgccagcccgctcagtccgtctagtgtctaccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagtgtctacgtcgacagatacgcagtattttggcccaggcacccggctgacagtgctcggtaagcgggggctcccgctgaagccccggaactggggagggggcgccccgggacgctccgtctagtgtctacctgatggcgcgagggaggc

SEQ ID NO: 3348 - DNA, 495 bp, Artificial Sequence
  Oligonucleotide
gccttgccagcccgctcagtccgtctagtacagtgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctagtacagtggtcgacaaaacattcagtacttcggcgccgggacccggctctcagtgctgggtaagctggggccgccgggggaccggggacgagactgcgctcgggtttttgtgcgtccgtctagtacagtgctgatggcgcgagggaggc

SEQ ID NO: 3349 - DNA, 495 bp, Artificial Sequence
  Oligonucleotide
gccttgccagcccgctcagtccgtctaggatcatccttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaggatcatcgtcgacgagacccagtacttcgggccaggcacgcggctcctggtgctcggtgagcgcgggctgctggggcgcgggcgcgggcggcttgggtctggtttttgcggggtccgtctaggatcatcctgatggcgcgagggaggc

SEQ ID NO: 3350 - DNA, 495 bp, Artificial Sequence
  Oligonucleotide
gccttgccagcccgctcagtccgtctatattggcgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctatattggcggtcgacgggccaacgtcctgactttcggggccggcagcaggctgaccgtgctgggtgagttttcgcgggaccacccgggcggcgggattcaggtggaaggcggcggtccgtctatattggcgctgatggcgcgagggaggc

SEQ ID NO: 3351 - DNA, 495 bp, Artificial Sequence
  Oligonucleotide
gccttgccagcccgctcagtccgtctaaggcttgacttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcatgatccgtctaaggcttgagtcgacacgagcagtacttcgggccgggcaccaggctcacggtcacaggtgagattcgggcgtctccccaccttccagcccctcggtccccggagtcggagggtggtccgtctaaggcttgactgatggcgcgagggaggc

SEQ ID NO: 3352 - DNA, 495 bp, Artificial Sequence
  Oligonucleotide
gccttgccagcccgctcagaagagctggacactctcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggacactctgtcgacactgaagctttctttggacaaggcaccagactcacagttgtaggtaagacatttttcaggttcttttgcagatccgtcacagggaaaagtgggtccacagaagagctggacactctctgatggcgcgagggaggc

SEQ ID NO: 3353 - DNA, 495 bp, Artificial Sequence
  Oligonucleotide
gccttgccagcccgctcagaagagctgttcggaaccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgttcggaacgtcgactatggctacaccttcggttcggggaccaggttaaccgttgtaggtaaggctgggggtctctaggaggggtgcgatgagggaggactctgtcctgggaaataagagctgttcggaacctgatggcgcgagggaggc

SEQ ID NO: 3354 - DNA, 495 bp, Artificial Sequence
  Oligonucleotide
gccttgccagcccgctcagaagagctgaagtaacgcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgaagtaacggtcgacgaaacaccatatattttggagagggaagttggctcactgttgtaggtgagtaagtcaaggctggacagctgggaacttgcaaaaaggggctggaatccagaagagctgaagtaacgctgatggcgcgagggaggc

SEQ ID NO: 3355 - DNA, 495 bp, Artificial Sequence
  Oligonucleotide
gccttgccagcccgctcagaagagctggtctcctacttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggtctcctagtcgacaatgaaaaactgttttttggcagtggaacccagctctctgtcttgggtatgtaaaagacttctttcgggatagtgtatcataaggtcggagttccaggagaagagctggtctcctactgatggcgcgagggaggc

SEQ ID NO: 3356 - DNA, 495 bp, Artificial Sequence
  Oligonucleotide
gccttgccagcccgctcagaagagctgagagtgtccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgagagtgtcgtcgacatcagccccagcattttggtgatgggactcgactctccatcctaggtaagttgcagaatcagggtggtatggccattgtcccttgaaggcagagttctctaagagctgagagtgtcctgatggcgcgagggaggc

SEQ ID NO: 3357 - DNA, 495 bp, Artificial Sequence
  Oligonucleotide
gccttgccagcccgctcagaagagctggttccgaacttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggttccgaagtcgacataattcacccctccactttgggaacgggaccaggctcactgtgacaggtatgggggctccactcttgactcgggggtgcctgggtttgactgcaatgataagagctggttccgaactgatggcgcgagggaggc

SEQ ID NO: 3358 - DNA, 495 bp, Artificial Sequence
  Oligonucleotide
gccttgccagcccgctcagaagagctgcgttacttcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgcgttacttgtcgacacaatgagcagttcttcgggccagggacacggctcaccgtgctaggtaagaagggggctccaggtgggagagagggtgagcagcccagcctgcacgacccaagagctgcgttacttctgatggcgcgagggaggc

SEQ ID NO: 3359 - DNA, 495 bp, Artificial Sequence
  Oligonucleotide
gccttgccagcccgctcagaagagctgtaggagaccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgtaggagacgtcgacaccggggagctgttttttggagaaggctctaggctgaccgtactgggtaaggaggcggttggggctccggagagctccgagagggcgggatgggcagaggaagagctgtaggagacctgatggcgcgagggaggc

SEQ ID NO: 3360 - DNA, 495 bp, Artificial Sequence
  Oligonucleotide
gccttgccagcccgctcagaagagctggtgtctaccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggtgtctacgtcgacagatacgcagtattttggcccaggcacccggctgacagtgctcggtaagcgggggctcccgctgaagccccggaactggggagggggcgccccgggacgcaagagctggtgtctacctgatggcgcgagggaggc

SEQ ID NO: 3361 - DNA, 495 bp, Artificial Sequence
  Oligonucleotide
gccttgccagcccgctcagaagagctggtacagtgcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctggtacagtggtcgacaaaacattcagtacttcggcgccgggacccggctctcagtgctgggtaagctggggccgccgggggaccggggacgagactgcgctcgggtttttgtgcgaagagctggtacagtgctgatggcgcgagggaggc

SEQ ID NO: 3362 - DNA, 495 bp, Artificial Sequence
  Oligonucleotide
gccttgccagcccgctcagaagagctgggatcatccttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgggatcatcgtcgacgagacccagtacttcgggccaggcacgcggctcctggtgctcggtgagcgcgggctgctggggcgcgggcgcgggcggcttgggtctggtttttgcggggaagagctgggatcatcctgatggcgcgagggaggc

SEQ ID NO: 3363 - DNA, 495 bp, Artificial Sequence
  Oligonucleotide
gccttgccagcccgctcagaagagctgtattggcgcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgtattggcggtcgacgggccaacgtcctgactttcggggccggcagcaggctgaccgtgctgggtgagttttcgcgggaccacccgggcggcgggattcaggtggaaggcggcggaagagctgtattggcgctgatggcgcgagggaggc

SEQ ID NO: 3364 - DNA, 495 bp, Artificial Sequence
  Oligonucleotide
gccttgccagcccgctcagaagagctgaggcttgacttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaaagagctgaggcttgagtcgacacgagcagtacttcgggccgggcaccaggctcacggtcacaggtgagattcgggcgtctccccaccttccagcccctcggtccccggagtcggagggtggaagagctgaggcttgactgatggcgcgagggaggc

SEQ ID NO: 3365 - DNA, 495 bp, Artificial Sequence
  Oligonucleotide
gccttgccagcccgctcagtcagatgcgacactctcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgacactctgtcgacactgaagctttctttggacaaggcaccagactcacagttgtaggtaagacatttttcaggttcttttgcagatccgtcacagggaaaagtgggtccacagtcagatgcgacactctctgatggcgcgagggaggc

SEQ ID NO: 3366 - DNA, 495 bp, Artificial Sequence
  Oligonucleotide
gccttgccagcccgctcagtcagatgcttcggaaccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcttcggaacgtcgactatggctacaccttcggttcggggaccaggttaaccgttgtaggtaaggctgggggtctctaggaggggtgcgatgagggaggactctgtcctgggaaattcagatgcttcggaacctgatggcgcgagggaggc

SEQ ID NO: 3367 - DNA, 495 bp, Artificial Sequence
  Oligonucleotide
gccttgccagcccgctcagtcagatgcaagtaacgcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcaagtaacggtcgacgaaacaccatatattttggagagggaagttggctcactgttgtaggtgagtaagtcaaggctggacagctgggaacttgcaaaaaggggctggaatccagtcagatgcaagtaacgctgatggcgcgagggaggc

SEQ ID NO: 3368 - DNA, 495 bp, Artificial Sequence
  Oligonucleotide
gccttgccagcccgctcagtcagatgcgtctcctacttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgtctcctagtcgacaatgaaaaactgttttttggcagtggaacccagctctctgtcttgggtatgtaaaagacttctttcgggatagtgtatcataaggtcggagttccaggagtcagatgcgtctcctactgatggcgcgagggaggc

SEQ ID NO: 3369 - DNA, 495 bp, Artificial Sequence
  Oligonucleotide
gccttgccagcccgctcagtcagatgcagagtgtccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcagagtgtcgtcgacatcagccccagcattttggtgatgggactcgactctccatcctaggtaagttgcagaatcagggtggtatggccattgtcccttgaaggcagagttctcttcagatgcagagtgtcctgatggcgcgagggaggc

SEQ ID NO: 3370 - DNA, 495 bp, Artificial Sequence
  Oligonucleotide
gccttgccagcccgctcagtcagatgcgttccgaacttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgttccgaagtcgacataattcacccctccactttgggaacgggaccaggctcactgtgacaggtatgggggctccactcttgactcgggggtgcctgggtttgactgcaatgattcagatgcgttccgaactgatggcgcgagggaggc

SEQ ID NO: 3371 - DNA, 495 bp, Artificial Sequence
  Oligonucleotide
gccttgccagcccgctcagtcagatgccgttacttcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgccgttacttgtcgacacaatgagcagttcttcgggccagggacacggctcaccgtgctaggtaagaagggggctccaggtgggagagagggtgagcagcccagcctgcacgaccctcagatgccgttacttctgatggcgcgagggaggc

SEQ ID NO: 3372 - DNA, 495 bp, Artificial Sequence
  Oligonucleotide
gccttgccagcccgctcagtcagatgctaggagaccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgctaggagacgtcgacaccggggagctgttttttggagaaggctctaggctgaccgtactgggtaaggaggcggttggggctccggagagctccgagagggcgggatgggcagaggtcagatgctaggagacctgatggcgcgagggaggc

SEQ ID NO: 3373 - DNA, 495 bp, Artificial Sequence
  Oligonucleotide
gccttgccagcccgctcagtcagatgcgtgtctaccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgtgtctacgtcgacagatacgcagtattttggcccaggcacccggctgacagtgctcggtaagcgggggctcccgctgaagccccggaactggggagggggcgccccgggacgctcagatgcgtgtctacctgatggcgcgagggaggc

SEQ ID NO: 3374 - DNA, 495 bp, Artificial Sequence
  Oligonucleotide
gccttgccagcccgctcagtcagatgcgtacagtgcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcgtacagtggtcgacaaaacattcagtacttcggcgccgggacccggctctcagtgctgggtaagctggggccgccgggggaccggggacgagactgcgctcgggtttttgtgcgtcagatgcgtacagtgctgatggcgcgagggaggc

SEQ ID NO: 3375 - DNA, 495 bp, Artificial Sequence
  Oligonucleotide
gccttgccagcccgctcagtcagatgcggatcatccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcggatcatcgtcgacgagacccagtacttcgggccaggcacgcggctcctggtgctcggtgagcgcgggctgctggggcgcgggcgcgggcggcttgggtctggtttttgcggggtcagatgcggatcatcctgatggcgcgagggaggc

SEQ ID NO: 3376 - DNA, 495 bp, Artificial Sequence
  Oligonucleotide
gccttgccagcccgctcagtcagatgctattggcgcttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgctattggcggtcgacgggccaacgtcctgactttcggggccggcagcaggctgaccgtgctgggtgagttttcgcgggaccacccgggcggcgggattcaggtggaaggcggcggtcagatgctattggcgctgatggcgcgagggaggc

SEQ ID NO: 3377 - DNA, 495 bp, Artificial Sequence
  Oligonucleotide
gccttgccagcccgctcagtcagatgcaggcttgacttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagtgatcagatgcaggcttgagtcgacacgagcagtacttcgggccgggcaccaggctcacggtcacaggtgagattcgggcgtctccccaccttccagcccctcggtccccggagtcggagggtggtcagatgcaggcttgactgatggcgcgagggaggc

SEQ ID NO: 3378 - DNA, 495 bp, Artificial Sequence
  Oligonucleotide
gccttgccagcccgctcaggtgtagcagacactctcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagacactctgtcgacactgaagctttctttggacaaggcaccagactcacagttgtaggtaagacatttttcaggttcttttgcagatccgtcacagggaaaagtgggtccacaggtgtagcagacactctctgatggcgcgagggaggc

SEQ ID NO: 3379 - DNA, 495 bp, Artificial Sequence
  Oligonucleotide
gccttgccagcccgctcaggtgtagcattcggaaccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcattcggaacgtcgactatggctacaccttcggttcggggaccaggttaaccgttgtaggtaaggctgggggtctctaggaggggtgcgatgagggaggactctgtcctgggaaatgtgtagcattcggaacctgatggcgcgagggaggc

SEQ ID NO: 3380 - DNA, 495 bp, Artificial Sequence
  Oligonucleotide
gccttgccagcccgctcaggtgtagcaaagtaacgcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaaagtaacggtcgacgaaacaccatatattttggagagggaagttggctcactgttgtaggtgagtaagtcaaggctggacagctgggaacttgcaaaaaggggctggaatccaggtgtagcaaagtaacgctgatggcgcgagggaggc

SEQ ID NO: 3381 - DNA, 495 bp, Artificial Sequence
  Oligonucleotide
gccttgccagcccgctcaggtgtagcagtctcctacttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagtctcctagtcgacaatgaaaaactgttttttggcagtggaacccagctctctgtcttgggtatgtaaaagacttctttcgggatagtgtatcataaggtcggagttccaggaggtgtagcagtctcctactgatggcgcgagggaggc

SEQ ID NO: 3382 - DNA, 495 bp, Artificial Sequence
  Oligonucleotide
gccttgccagcccgctcaggtgtagcaagagtgtccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaagagtgtcgtcgacatcagccccagcattttggtgatgggactcgactctccatcctaggtaagttgcagaatcagggtggtatggccattgtcccttgaaggcagagttctctgtgtagcaagagtgtcctgatggcgcgagggaggc

SEQ ID NO: 3383 - DNA, 495 bp, Artificial Sequence
  Oligonucleotide
gccttgccagcccgctcaggtgtagcagttccgaacttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagttccgaagtcgacataattcacccctccactttgggaacgggaccaggctcactgtgacaggtatgggggctccactcttgactcgggggtgcctgggtttgactgcaatgatgtgtagcagttccgaactgatggcgcgagggaggc

SEQ ID NO: 3384 - DNA, 495 bp, Artificial Sequence
  Oligonucleotide
gccttgccagcccgctcaggtgtagcacgttacttcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcacgttacttgtcgacacaatgagcagttcttcgggccagggacacggctcaccgtgctaggtaagaagggggctccaggtgggagagagggtgagcagcccagcctgcacgacccgtgtagcacgttacttctgatggcgcgagggaggc

SEQ ID NO: 3385 - DNA, 495 bp, Artificial Sequence
  Oligonucleotide
gccttgccagcccgctcaggtgtagcataggagaccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcataggagacgtcgacaccggggagctgttttttggagaaggctctaggctgaccgtactgggtaaggaggcggttggggctccggagagctccgagagggcgggatgggcagagggtgtagcataggagacctgatggcgcgagggaggc

SEQ ID NO: 3386 - DNA, 495 bp, Artificial Sequence
  Oligonucleotide
gccttgccagcccgctcaggtgtagcagtgtctaccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagtgtctacgtcgacagatacgcagtattttggcccaggcacccggctgacagtgctcggtaagcgggggctcccgctgaagccccggaactggggagggggcgccccgggacgcgtgtagcagtgtctacctgatggcgcgagggaggc

SEQ ID NO: 3387 - DNA, 495 bp, Artificial Sequence
  Oligonucleotide
gccttgccagcccgctcaggtgtagcagtacagtgcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcagtacagtggtcgacaaaacattcagtacttcggcgccgggacccggctctcagtgctgggtaagctggggccgccgggggaccggggacgagactgcgctcgggtttttgtgcggtgtagcagtacagtgctgatggcgcgagggaggc

SEQ ID NO: 3388 - DNA, 495 bp, Artificial Sequence
  Oligonucleotide
gccttgccagcccgctcaggtgtagcaggatcatccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaggatcatcgtcgacgagacccagtacttcgggccaggcacgcggctcctggtgctcggtgagcgcgggctgctggggcgcgggcgcgggcggcttgggtctggtttttgcgggggtgtagcaggatcatcctgatggcgcgagggaggc

SEQ ID NO: 3389 - DNA, 495 bp, Artificial Sequence
  Oligonucleotide
gccttgccagcccgctcaggtgtagcatattggcgcttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcatattggcggtcgacgggccaacgtcctgactttcggggccggcagcaggctgaccgtgctgggtgagttttcgcgggaccacccgggcggcgggattcaggtggaaggcggcgggtgtagcatattggcgctgatggcgcgagggaggc

SEQ ID NO: 3390 - DNA, 495 bp, Artificial Sequence
  Oligonucleotide
gccttgccagcccgctcaggtgtagcaaggcttgacttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgagtgtagcaaggcttgagtcgacacgagcagtacttcgggccgggcaccaggctcacggtcacaggtgagattcgggcgtctccccaccttccagcccctcggtccccggagtcggagggtgggtgtagcaaggcttgactgatggcgcgagggaggc

SEQ ID NO: 3391 - DNA, 495 bp, Artificial Sequence
  Oligonucleotide
gccttgccagcccgctcagtggcagttgacactctcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgacactctgtcgacactgaagctttctttggacaaggcaccagactcacagttgtaggtaagacatttttcaggttcttttgcagatccgtcacagggaaaagtgggtccacagtggcagttgacactctctgatggcgcgagggaggc

SEQ ID NO: 3392 - DNA, 495 bp, Artificial Sequence
  Oligonucleotide
gccttgccagcccgctcagtggcagttttcggaaccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttttcggaacgtcgactatggctacaccttcggttcggggaccaggttaaccgttgtaggtaaggctgggggtctctaggaggggtgcgatgagggaggactctgtcctgggaaattggcagttttcggaacctgatggcgcgagggaggc

SEQ ID NO: 3393 - DNA, 495 bp, Artificial Sequence
  Oligonucleotide
gccttgccagcccgctcagtggcagttaagtaacgcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttaagtaacggtcgacgaaacaccatatattttggagagggaagttggctcactgttgtaggtgagtaagtcaaggctggacagctgggaacttgcaaaaaggggctggaatccagtggcagttaagtaacgctgatggcgcgagggaggc

SEQ ID NO: 3394 - DNA, 495 bp, Artificial Sequence
  Oligonucleotide
gccttgccagcccgctcagtggcagttgtctcctacttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgtctcctagtcgacaatgaaaaactgttttttggcagtggaacccagctctctgtcttgggtatgtaaaagacttctttcgggatagtgtatcataaggtcggagttccaggagtggcagttgtctcctactgatggcgcgagggaggc

SEQ ID NO: 3395 - DNA, 495 bp, Artificial Sequence
  Oligonucleotide
gccttgccagcccgctcagtggcagttagagtgtccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttagagtgtcgtcgacatcagccccagcattttggtgatgggactcgactctccatcctaggtaagttgcagaatcagggtggtatggccattgtcccttgaaggcagagttctcttggcagttagagtgtcctgatggcgcgagggaggc

SEQ ID NO: 3396 - DNA, 495 bp, Artificial Sequence
  Oligonucleotide
gccttgccagcccgctcagtggcagttgttccgaacttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgttccgaagtcgacataattcacccctccactttgggaacgggaccaggctcactgtgacaggtatgggggctccactcttgactcgggggtgcctgggtttgactgcaatgattggcagttgttccgaactgatggcgcgagggaggc

SEQ ID NO: 3397 - DNA, 495 bp, Artificial Sequence
  Oligonucleotide
gccttgccagcccgctcagtggcagttcgttacttcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttcgttacttgtcgacacaatgagcagttcttcgggccagggacacggctcaccgtgctaggtaagaagggggctccaggtgggagagagggtgagcagcccagcctgcacgaccctggcagttcgttacttctgatggcgcgagggaggc

SEQ ID NO: 3398 - DNA, 495 bp, Artificial Sequence
  Oligonucleotide
gccttgccagcccgctcagtggcagtttaggagaccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagtttaggagacgtcgacaccggggagctgttttttggagaaggctctaggctgaccgtactgggtaaggaggcggttggggctccggagagctccgagagggcgggatgggcagaggtggcagtttaggagacctgatggcgcgagggaggc

SEQ ID NO: 3399 - DNA, 495 bp, Artificial Sequence
  Oligonucleotide
gccttgccagcccgctcagtggcagttgtgtctaccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgtgtctacgtcgacagatacgcagtattttggcccaggcacccggctgacagtgctcggtaagcgggggctcccgctgaagccccggaactggggagggggcgccccgggacgctggcagttgtgtctacctgatggcgcgagggaggc

SEQ ID NO: 3400 - DNA, 495 bp, Artificial Sequence
  Oligonucleotide
gccttgccagcccgctcagtggcagttgtacagtgcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttgtacagtggtcgacaaaacattcagtacttcggcgccgggacccggctctcagtgctgggtaagctggggccgccgggggaccggggacgagactgcgctcgggtttttgtgcgtggcagttgtacagtgctgatggcgcgagggaggc

SEQ ID NO: 3401 - DNA, 495 bp, Artificial Sequence
  Oligonucleotide
gccttgccagcccgctcagtggcagttggatcatccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttggatcatcgtcgacgagacccagtacttcgggccaggcacgcggctcctggtgctcggtgagcgcgggctgctggggcgcgggcgcgggcggcttgggtctggtttttgcggggtggcagttggatcatcctgatggcgcgagggaggc

SEQ ID NO: 3402 - DNA, 495 bp, Artificial Sequence
  Oligonucleotide
gccttgccagcccgctcagtggcagtttattggcgcttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagtttattggcggtcgacgggccaacgtcctgactttcggggccggcagcaggctgaccgtgctgggtgagttttcgcgggaccacccgggcggcgggattcaggtggaaggcggcggtggcagtttattggcgctgatggcgcgagggaggc

SEQ ID NO: 3403 - DNA, 495 bp, Artificial Sequence
  Oligonucleotide
gccttgccagcccgctcagtggcagttaggcttgacttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtgatggcagttaggcttgagtcgacacgagcagtacttcgggccgggcaccaggctcacggtcacaggtgagattcgggcgtctccccaccttccagcccctcggtccccggagtcggagggtggtggcagttaggcttgactgatggcgcgagggaggc

SEQ ID NO: 3404 - DNA, 495 bp, Artificial Sequence
  Oligonucleotide
gccttgccagcccgctcagcagtccaagacactctcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagacactctgtcgacactgaagctttctttggacaaggcaccagactcacagttgtaggtaagacatttttcaggttcttttgcagatccgtcacagggaaaagtgggtccacagcagtccaagacactctctgatggcgcgagggaggc

SEQ ID NO: 3405 - DNA, 495 bp, Artificial Sequence
  Oligonucleotide
gccttgccagcccgctcagcagtccaattcggaaccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaattcggaacgtcgactatggctacaccttcggttcggggaccaggttaaccgttgtaggtaaggctgggggtctctaggaggggtgcgatgagggaggactctgtcctgggaaatcagtccaattcggaacctgatggcgcgagggaggc

SEQ ID NO: 3406 - DNA, 495 bp, Artificial Sequence
  Oligonucleotide
gccttgccagcccgctcagcagtccaaaagtaacgcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaaagtaacggtcgacgaaacaccatatattttggagagggaagttggctcactgttgtaggtgagtaagtcaaggctggacagctgggaacttgcaaaaaggggctggaatccagcagtccaaaagtaacgctgatggcgcgagggaggc

SEQ ID NO: 3407 - DNA, 495 bp, Artificial Sequence
  Oligonucleotide
gccttgccagcccgctcagcagtccaagtctcctacttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagtctcctagtcgacaatgaaaaactgttttttggcagtggaacccagctctctgtcttgggtatgtaaaagacttctttcgggatagtgtatcataaggtcggagttccaggagcagtccaagtctcctactgatggcgcgagggaggc

SEQ ID NO: 3408 - DNA, 495 bp, Artificial Sequence
  Oligonucleotide
gccttgccagcccgctcagcagtccaaagagtgtccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaagagtgtcgtcgacatcagccccagcattttggtgatgggactcgactctccatcctaggtaagttgcagaatcagggtggtatggccattgtcccttgaaggcagagttctctcagtccaaagagtgtcctgatggcgcgagggaggc

SEQ ID NO: 3409 - DNA, 495 bp, Artificial Sequence
  Oligonucleotide
gccttgccagcccgctcagcagtccaagttccgaacttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagttccgaagtcgacataattcacccctccactttgggaacgggaccaggctcactgtgacaggtatgggggctccactcttgactcgggggtgcctgggtttgactgcaatgatcagtccaagttccgaactgatggcgcgagggaggc

SEQ ID NO: 3410 - DNA, 495 bp, Artificial Sequence
  Oligonucleotide
gccttgccagcccgctcagcagtccaacgttacttcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaacgttacttgtcgacacaatgagcagttcttcgggccagggacacggctcaccgtgctaggtaagaagggggctccaggtgggagagagggtgagcagcccagcctgcacgaccccagtccaacgttacttctgatggcgcgagggaggc

SEQ ID NO: 3411 - DNA, 495 bp, Artificial Sequence
  Oligonucleotide
gccttgccagcccgctcagcagtccaataggagaccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaataggagacgtcgacaccggggagctgttttttggagaaggctctaggctgaccgtactgggtaaggaggcggttggggctccggagagctccgagagggcgggatgggcagaggcagtccaataggagacctgatggcgcgagggaggc

SEQ ID NO: 3412 - DNA, 495 bp, Artificial Sequence
  Oligonucleotide
gccttgccagcccgctcagcagtccaagtgtctaccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagtgtctacgtcgacagatacgcagtattttggcccaggcacccggctgacagtgctcggtaagcgggggctcccgctgaagccccggaactggggagggggcgccccgggacgccagtccaagtgtctacctgatggcgcgagggaggc

SEQ ID NO: 3413 - DNA, 495 bp, Artificial Sequence
  Oligonucleotide
gccttgccagcccgctcagcagtccaagtacagtgcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaagtacagtggtcgacaaaacattcagtacttcggcgccgggacccggctctcagtgctgggtaagctggggccgccgggggaccggggacgagactgcgctcgggtttttgtgcgcagtccaagtacagtgctgatggcgcgagggaggc

SEQ ID NO: 3414 - DNA, 495 bp, Artificial Sequence
  Oligonucleotide
gccttgccagcccgctcagcagtccaaggatcatccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaggatcatcgtcgacgagacccagtacttcgggccaggcacgcggctcctggtgctcggtgagcgcgggctgctggggcgcgggcgcgggcggcttgggtctggtttttgcggggcagtccaaggatcatcctgatggcgcgagggaggc

SEQ ID NO: 3415 - DNA, 495 bp, Artificial Sequence
  Oligonucleotide
gccttgccagcccgctcagcagtccaatattggcgcttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaatattggcggtcgacgggccaacgtcctgactttcggggccggcagcaggctgaccgtgctgggtgagttttcgcgggaccacccgggcggcgggattcaggtggaaggcggcggcagtccaatattggcgctgatggcgcgagggaggc

SEQ ID NO: 3416 - DNA, 495 bp, Artificial Sequence
  Oligonucleotide
gccttgccagcccgctcagcagtccaaaggcttgacttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagtgacagtccaaaggcttgagtcgacacgagcagtacttcgggccgggcaccaggctcacggtcacaggtgagattcgggcgtctccccaccttccagcccctcggtccccggagtcggagggtggcagtccaaaggcttgactgatggcgcgagggaggc

SEQ ID NO: 3417 - DNA, 495 bp, Artificial Sequence
  Oligonucleotide
gccttgccagcccgctcagtacgtacggacactctcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggacactctgtcgacactgaagctttctttggacaaggcaccagactcacagttgtaggtaagacatttttcaggttcttttgcagatccgtcacagggaaaagtgggtccacagtacgtacggacactctctgatggcgcgagggaggc

SEQ ID NO: 3418 - DNA, 495 bp, Artificial Sequence
  Oligonucleotide
gccttgccagcccgctcagtacgtacgttcggaaccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgttcggaacgtcgactatggctacaccttcggttcggggaccaggttaaccgttgtaggtaaggctgggggtctctaggaggggtgcgatgagggaggactctgtcctgggaaattacgtacgttcggaacctgatggcgcgagggaggc

SEQ ID NO: 3419 - DNA, 495 bp, Artificial Sequence
  Oligonucleotide
gccttgccagcccgctcagtacgtacgaagtaacgcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgaagtaacggtcgacgaaacaccatatattttggagagggaagttggctcactgttgtaggtgagtaagtcaaggctggacagctgggaacttgcaaaaaggggctggaatccagtacgtacgaagtaacgctgatggcgcgagggaggc

SEQ ID NO: 3420 - DNA, 495 bp, Artificial Sequence
  Oligonucleotide
gccttgccagcccgctcagtacgtacggtctcctacttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggtctcctagtcgacaatgaaaaactgttttttggcagtggaacccagctctctgtcttgggtatgtaaaagacttctttcgggatagtgtatcataaggtcggagttccaggagtacgtacggtctcctactgatggcgcgagggaggc

SEQ ID NO: 3421 - DNA, 495 bp, Artificial Sequence
  Oligonucleotide
gccttgccagcccgctcagtacgtacgagagtgtccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgagagtgtcgtcgacatcagccccagcattttggtgatgggactcgactctccatcctaggtaagttgcagaatcagggtggtatggccattgtcccttgaaggcagagttctcttacgtacgagagtgtcctgatggcgcgagggaggc

SEQ ID NO: 3422 - DNA, 495 bp, Artificial Sequence
  Oligonucleotide
gccttgccagcccgctcagtacgtacggttccgaacttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggttccgaagtcgacataattcacccctccactttgggaacgggaccaggctcactgtgacaggtatgggggctccactcttgactcgggggtgcctgggtttgactgcaatgattacgtacggttccgaactgatggcgcgagggaggc

SEQ ID NO: 3423 - DNA, 495 bp, Artificial Sequence
  Oligonucleotide
gccttgccagcccgctcagtacgtacgcgttacttcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgcgttacttgtcgacacaatgagcagttcttcgggccagggacacggctcaccgtgctaggtaagaagggggctccaggtgggagagagggtgagcagcccagcctgcacgaccctacgtacgcgttacttctgatggcgcgagggaggc

SEQ ID NO: 3424 - DNA, 495 bp, Artificial Sequence
  Oligonucleotide
gccttgccagcccgctcagtacgtacgtaggagaccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgtaggagacgtcgacaccggggagctgttttttggagaaggctctaggctgaccgtactgggtaaggaggcggttggggctccggagagctccgagagggcgggatgggcagaggtacgtacgtaggagacctgatggcgcgagggaggc

SEQ ID NO: 3425 - DNA, 495 bp, Artificial Sequence
  Oligonucleotide
gccttgccagcccgctcagtacgtacggtgtctaccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggtgtctacgtcgacagatacgcagtattttggcccaggcacccggctgacagtgctcggtaagcgggggctcccgctgaagccccggaactggggagggggcgccccgggacgctacgtacggtgtctacctgatggcgcgagggaggc

SEQ ID NO: 3426 - DNA, 495 bp, Artificial Sequence
  Oligonucleotide
gccttgccagcccgctcagtacgtacggtacagtgcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacggtacagtggtcgacaaaacattcagtacttcggcgccgggacccggctctcagtgctgggtaagctggggccgccgggggaccggggacgagactgcgctcgggtttttgtgcgtacgtacggtacagtgctgatggcgcgagggaggc

SEQ ID NO: 3427 - DNA, 495 bp, Artificial Sequence
  Oligonucleotide
gccttgccagcccgctcagtacgtacgggatcatccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgggatcatcgtcgacgagacccagtacttcgggccaggcacgcggctcctggtgctcggtgagcgcgggctgctggggcgcgggcgcgggcggcttgggtctggtttttgcggggtacgtacgggatcatcctgatggcgcgagggaggc

SEQ ID NO: 3428 - DNA, 495 bp, Artificial Sequence
  Oligonucleotide
gccttgccagcccgctcagtacgtacgtattggcgcttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgtattggcggtcgacgggccaacgtcctgactttcggggccggcagcaggctgaccgtgctgggtgagttttcgcgggaccacccgggcggcgggattcaggtggaaggcggcggtacgtacgtattggcgctgatggcgcgagggaggc

SEQ ID NO: 3429 - DNA, 495 bp, Artificial Sequence
  Oligonucleotide
gccttgccagcccgctcagtacgtacgaggcttgacttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagtgatacgtacgaggcttgagtcgacacgagcagtacttcgggccgggcaccaggctcacggtcacaggtgagattcgggcgtctccccaccttccagcccctcggtccccggagtcggagggtggtacgtacgaggcttgactgatggcgcgagggaggc

SEQ ID NO: 3430 - DNA, 495 bp, Artificial Sequence
  Oligonucleotide
gccttgccagcccgctcagagtaccgagacactctgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagacactctgtcgacactgaagctttctttggacaaggcaccagactcacagttgtaggtaagacatttttcaggttcttttgcagatccgtcacagggaaaagtgggtccacagagtaccgagacactctctgatggcgcgagggaggc

SEQ ID NO: 3431 - DNA, 495 bp, Artificial Sequence
  Oligonucleotide
gccttgccagcccgctcagagtaccgattcggaacgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgattcggaacgtcgactatggctacaccttcggttcggggaccaggttaaccgttgtaggtaaggctgggggtctctaggaggggtgcgatgagggaggactctgtcctgggaaatagtaccgattcggaacctgatggcgcgagggaggc

SEQ ID NO: 3432 - DNA, 495 bp, Artificial Sequence
  Oligonucleotide
gccttgccagcccgctcagagtaccgaaagtaacggttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaaagtaacggtcgacgaaacaccatatattttggagagggaagttggctcactgttgtaggtgagtaagtcaaggctggacagctgggaacttgcaaaaaggggctggaatccagagtaccgaaagtaacgctgatggcgcgagggaggc

SEQ ID NO: 3433 - DNA, 495 bp, Artificial Sequence
  Oligonucleotide
gccttgccagcccgctcagagtaccgagtctcctagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagtctcctagtcgacaatgaaaaactgttttttggcagtggaacccagctctctgtcttgggtatgtaaaagacttctttcgggatagtgtatcataaggtcggagttccaggagagtaccgagtctcctactgatggcgcgagggaggc

SEQ ID NO: 3434 - DNA, 495 bp, Artificial Sequence
  Oligonucleotide
gccttgccagcccgctcagagtaccgaagagtgtcgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaagagtgtcgtcgacatcagccccagcattttggtgatgggactcgactctccatcctaggtaagttgcagaatcagggtggtatggccattgtcccttgaaggcagagttctctagtaccgaagagtgtcctgatggcgcgagggaggc

SEQ ID NO: 3435 - DNA, 495 bp, Artificial Sequence
  Oligonucleotide
gccttgccagcccgctcagagtaccgagttccgaagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagttccgaagtcgacataattcacccctccactttgggaacgggaccaggctcactgtgacaggtatgggggctccactcttgactcgggggtgcctgggtttgactgcaatgatagtaccgagttccgaactgatggcgcgagggaggc

SEQ ID NO: 3436 - DNA, 495 bp, Artificial Sequence
  Oligonucleotide
gccttgccagcccgctcagagtaccgacgttacttgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgacgttacttgtcgacacaatgagcagttcttcgggccagggacacggctcaccgtgctaggtaagaagggggctccaggtgggagagagggtgagcagcccagcctgcacgacccagtaccgacgttacttctgatggcgcgagggaggc

SEQ ID NO: 3437 - DNA, 495 bp, Artificial Sequence
  Oligonucleotide
gccttgccagcccgctcagagtaccgataggagacgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgataggagacgtcgacaccggggagctgttttttggagaaggctctaggctgaccgtactgggtaaggaggcggttggggctccggagagctccgagagggcgggatgggcagaggagtaccgataggagacctgatggcgcgagggaggc

SEQ ID NO: 3438 - DNA, 495 bp, Artificial Sequence
  Oligonucleotide
gccttgccagcccgctcagagtaccgagtgtctacgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagtgtctacgtcgacagatacgcagtattttggcccaggcacccggctgacagtgctcggtaagcgggggctcccgctgaagccccggaactggggagggggcgccccgggacgcagtaccgagtgtctacctgatggcgcgagggaggc

SEQ ID NO: 3439 - DNA, 495 bp, Artificial Sequence
  Oligonucleotide
gccttgccagcccgctcagagtaccgagtacagtggttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgagtacagtggtcgacaaaacattcagtacttcggcgccgggacccggctctcagtgctgggtaagctggggccgccgggggaccggggacgagactgcgctcgggtttttgtgcgagtaccgagtacagtgctgatggcgcgagggaggc

SEQ ID NO: 3440 - DNA, 495 bp, Artificial Sequence
  Oligonucleotide
gccttgccagcccgctcagagtaccgaggatcatcgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaggatcatcgtcgacgagacccagtacttcgggccaggcacgcggctcctggtgctcggtgagcgcgggctgctggggcgcgggcgcgggcggcttgggtctggtttttgcggggagtaccgaggatcatcctgatggcgcgagggaggc

SEQ ID NO: 3441 - DNA, 495 bp, Artificial Sequence
  Oligonucleotide
gccttgccagcccgctcagagtaccgatattggcggttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgatattggcggtcgacgggccaacgtcctgactttcggggccggcagcaggctgaccgtgctgggtgagttttcgcgggaccacccgggcggcgggattcaggtggaaggcggcggagtaccgatattggcgctgatggcgcgagggaggc

SEQ ID NO: 3442 - DNA, 495 bp, Artificial Sequence
  Oligonucleotide
gccttgccagcccgctcagagtaccgaaggcttgagttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagtgaagtaccgaaggcttgagtcgacacgagcagtacttcgggccgggcaccaggctcacggtcacaggtgagattcgggcgtctccccaccttccagcccctcggtccccggagtcggagggtggagtaccgaaggcttgactgatggcgcgagggaggc

SEQ ID NO: 3443 - DNA, 495 bp, Artificial Sequence
  Oligonucleotide
gccttgccagcccgctcagatccatgggacactctcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggacactctgtcgacactgaagctttctttggacaaggcaccagactcacagttgtaggtaagacatttttcaggttcttttgcagatccgtcacagggaaaagtgggtccacagatccatgggacactctctgatggcgcgagggaggc

SEQ ID NO: 3444 - DNA, 495 bp, Artificial Sequence
  Oligonucleotide
gccttgccagcccgctcagatccatggttcggaaccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggttcggaacgtcgactatggctacaccttcggttcggggaccaggttaaccgttgtaggtaaggctgggggtctctaggaggggtgcgatgagggaggactctgtcctgggaaatatccatggttcggaacctgatggcgcgagggaggc

SEQ ID NO: 3445 - DNA, 495 bp, Artificial Sequence
  Oligonucleotide
gccttgccagcccgctcagatccatggaagtaacgcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggaagtaacggtcgacgaaacaccatatattttggagagggaagttggctcactgttgtaggtgagtaagtcaaggctggacagctgggaacttgcaaaaaggggctggaatccagatccatggaagtaacgctgatggcgcgagggaggc

SEQ ID NO: 3446 - DNA, 495 bp, Artificial Sequence
  Oligonucleotide
gccttgccagcccgctcagatccatgggtctcctacttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggtctcctagtcgacaatgaaaaactgttttttggcagtggaacccagctctctgtcttgggtatgtaaaagacttctttcgggatagtgtatcataaggtcggagttccaggagatccatgggtctcctactgatggcgcgagggaggc

SEQ ID NO: 3447 - DNA, 495 bp, Artificial Sequence
  Oligonucleotide
gccttgccagcccgctcagatccatggagagtgtccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggagagtgtcgtcgacatcagccccagcattttggtgatgggactcgactctccatcctaggtaagttgcagaatcagggtggtatggccattgtcccttgaaggcagagttctctatccatggagagtgtcctgatggcgcgagggaggc

SEQ ID NO: 3448 - DNA, 495 bp, Artificial Sequence
  Oligonucleotide
gccttgccagcccgctcagatccatgggttccgaacttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggttccgaagtcgacataattcacccctccactttgggaacgggaccaggctcactgtgacaggtatgggggctccactcttgactcgggggtgcctgggtttgactgcaatgatatccatgggttccgaactgatggcgcgagggaggc

SEQ ID NO: 3449 - DNA, 495 bp, Artificial Sequence
  Oligonucleotide
gccttgccagcccgctcagatccatggcgttacttcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggcgttacttgtcgacacaatgagcagttcttcgggccagggacacggctcaccgtgctaggtaagaagggggctccaggtgggagagagggtgagcagcccagcctgcacgacccatccatggcgttacttctgatggcgcgagggaggc

SEQ ID NO: 3450 - DNA, 495 bp, Artificial Sequence
  Oligonucleotide
gccttgccagcccgctcagatccatggtaggagaccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggtaggagacgtcgacaccggggagctgttttttggagaaggctctaggctgaccgtactgggtaaggaggcggttggggctccggagagctccgagagggcgggatgggcagaggatccatggtaggagacctgatggcgcgagggaggc

SEQ ID NO: 3451 - DNA, 495 bp, Artificial Sequence
  Oligonucleotide
gccttgccagcccgctcagatccatgggtgtctaccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggtgtctacgtcgacagatacgcagtattttggcccaggcacccggctgacagtgctcggtaagcgggggctcccgctgaagccccggaactggggagggggcgccccgggacgcatccatgggtgtctacctgatggcgcgagggaggc

SEQ ID NO: 3452 - DNA, 495 bp, Artificial Sequence
  Oligonucleotide
gccttgccagcccgctcagatccatgggtacagtgcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatgggtacagtggtcgacaaaacattcagtacttcggcgccgggacccggctctcagtgctgggtaagctggggccgccgggggaccggggacgagactgcgctcgggtttttgtgcgatccatgggtacagtgctgatggcgcgagggaggc

SEQ ID NO: 3453 - DNA, 495 bp, Artificial Sequence
  Oligonucleotide
gccttgccagcccgctcagatccatggggatcatccttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggggatcatcgtcgacgagacccagtacttcgggccaggcacgcggctcctggtgctcggtgagcgcgggctgctggggcgcgggcgcgggcggcttgggtctggtttttgcggggatccatggggatcatcctgatggcgcgagggaggc

SEQ ID NO: 3454 - DNA, 495 bp, Artificial Sequence
  Oligonucleotide
gccttgccagcccgctcagatccatggtattggcgcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggtattggcggtcgacgggccaacgtcctgactttcggggccggcagcaggctgaccgtgctgggtgagttttcgcgggaccacccgggcggcgggattcaggtggaaggcggcggatccatggtattggcgctgatggcgcgagggaggc

SEQ ID NO: 3455 - DNA, 495 bp, Artificial Sequence
  Oligonucleotide
gccttgccagcccgctcagatccatggaggcttgacttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagtgaatccatggaggcttgagtcgacacgagcagtacttcgggccgggcaccaggctcacggtcacaggtgagattcgggcgtctccccaccttccagcccctcggtccccggagtcggagggtggatccatggaggcttgactgatggcgcgagggaggc

SEQ ID NO: 3456 - DNA, 495 bp, Artificial Sequence
  Oligonucleotide
gccttgccagcccgctcaggtagcagtgacactctctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgacactctgtcgacactgaagctttctttggacaaggcaccagactcacagttgtaggtaagacatttttcaggttcttttgcagatccgtcacagggaaaagtgggtccacaggtagcagtgacactctctgatggcgcgagggaggc

SEQ ID NO: 3457 - DNA, 495 bp, Artificial Sequence
  Oligonucleotide
gccttgccagcccgctcaggtagcagtttcggaacctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtttcggaacgtcgactatggctacaccttcggttcggggaccaggttaaccgttgtaggtaaggctgggggtctctaggaggggtgcgatgagggaggactctgtcctgggaaatgtagcagtttcggaacctgatggcgcgagggaggc

SEQ ID NO: 3458 - DNA, 495 bp, Artificial Sequence
  Oligonucleotide
gccttgccagcccgctcaggtagcagtaagtaacgctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtaagtaacggtcgacgaaacaccatatattttggagagggaagttggctcactgttgtaggtgagtaagtcaaggctggacagctgggaacttgcaaaaaggggctggaatccaggtagcagtaagtaacgctgatggcgcgagggaggc

SEQ ID NO: 3459 - DNA, 495 bp, Artificial Sequence
  Oligonucleotide
gccttgccagcccgctcaggtagcagtgtctcctactccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgtctcctagtcgacaatgaaaaactgttttttggcagtggaacccagctctctgtcttgggtatgtaaaagacttctttcgggatagtgtatcataaggtcggagttccaggaggtagcagtgtctcctactgatggcgcgagggaggc

SEQ ID NO: 3460 - DNA, 495 bp, Artificial Sequence
  Oligonucleotide
gccttgccagcccgctcaggtagcagtagagtgtcctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtagagtgtcgtcgacatcagccccagcattttggtgatgggactcgactctccatcctaggtaagttgcagaatcagggtggtatggccattgtcccttgaaggcagagttctctgtagcagtagagtgtcctgatggcgcgagggaggc

SEQ ID NO: 3461 - DNA, 495 bp, Artificial Sequence
  Oligonucleotide
gccttgccagcccgctcaggtagcagtgttccgaactccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgttccgaagtcgacataattcacccctccactttgggaacgggaccaggctcactgtgacaggtatgggggctccactcttgactcgggggtgcctgggtttgactgcaatgatgtagcagtgttccgaactgatggcgcgagggaggc

SEQ ID NO: 3462 - DNA, 495 bp, Artificial Sequence
  Oligonucleotide
gccttgccagcccgctcaggtagcagtcgttacttctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtcgttacttgtcgacacaatgagcagttcttcgggccagggacacggctcaccgtgctaggtaagaagggggctccaggtgggagagagggtgagcagcccagcctgcacgacccgtagcagtcgttacttctgatggcgcgagggaggc

SEQ ID NO: 3463 - DNA, 495 bp, Artificial Sequence
  Oligonucleotide
gccttgccagcccgctcaggtagcagttaggagacctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagttaggagacgtcgacaccggggagctgttttttggagaaggctctaggctgaccgtactgggtaaggaggcggttggggctccggagagctccgagagggcgggatgggcagagggtagcagttaggagacctgatggcgcgagggaggc

SEQ ID NO: 3464 - DNA, 495 bp, Artificial Sequence
  Oligonucleotide
gccttgccagcccgctcaggtagcagtgtgtctacctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgtgtctacgtcgacagatacgcagtattttggcccaggcacccggctgacagtgctcggtaagcgggggctcccgctgaagccccggaactggggagggggcgccccgggacgcgtagcagtgtgtctacctgatggcgcgagggaggc

SEQ ID NO: 3465 - DNA, 495 bp, Artificial Sequence
  Oligonucleotide
gccttgccagcccgctcaggtagcagtgtacagtgctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtgtacagtggtcgacaaaacattcagtacttcggcgccgggacccggctctcagtgctgggtaagctggggccgccgggggaccggggacgagactgcgctcgggtttttgtgcggtagcagtgtacagtgctgatggcgcgagggaggc

SEQ ID NO: 3466 - DNA, 495 bp, Artificial Sequence
  Oligonucleotide
gccttgccagcccgctcaggtagcagtggatcatcctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtggatcatcgtcgacgagacccagtacttcgggccaggcacgcggctcctggtgctcggtgagcgcgggctgctggggcgcgggcgcgggcggcttgggtctggtttttgcgggggtagcagtggatcatcctgatggcgcgagggaggc

SEQ ID NO: 3467 - DNA, 495 bp, Artificial Sequence
  Oligonucleotide
gccttgccagcccgctcaggtagcagttattggcgctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagttattggcggtcgacgggccaacgtcctgactttcggggccggcagcaggctgaccgtgctgggtgagttttcgcgggaccacccgggcggcgggattcaggtggaaggcggcgggtagcagttattggcgctgatggcgcgagggaggc

SEQ ID NO: 3468 - DNA, 495 bp, Artificial Sequence
  Oligonucleotide
gccttgccagcccgctcaggtagcagtaggcttgactccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagtgagtagcagtaggcttgagtcgacacgagcagtacttcgggccgggcaccaggctcacggtcacaggtgagattcgggcgtctccccaccttccagcccctcggtccccggagtcggagggtgggtagcagtaggcttgactgatggcgcgagggaggc

SEQ ID NO: 3469 - DNA, 495 bp, Artificial Sequence
  Oligonucleotide
gccttgccagcccgctcagatcttcgtgacactctctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgacactctgtcgacactgaagctttctttggacaaggcaccagactcacagttgtaggtaagacatttttcaggttcttttgcagatccgtcacagggaaaagtgggtccacagatcttcgtgacactctctgatggcgcgagggaggc

SEQ ID NO: 3470 - DNA, 495 bp, Artificial Sequence
  Oligonucleotide
gccttgccagcccgctcagatcttcgtttcggaacctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtttcggaacgtcgactatggctacaccttcggttcggggaccaggttaaccgttgtaggtaaggctgggggtctctaggaggggtgcgatgagggaggactctgtcctgggaaatatcttcgtttcggaacctgatggcgcgagggaggc

SEQ ID NO: 3471 - DNA, 495 bp, Artificial Sequence
  Oligonucleotide
gccttgccagcccgctcagatcttcgtaagtaacgctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtaagtaacggtcgacgaaacaccatatattttggagagggaagttggctcactgttgtaggtgagtaagtcaaggctggacagctgggaacttgcaaaaaggggctggaatccagatcttcgtaagtaacgctgatggcgcgagggaggc

SEQ ID NO: 3472 - DNA, 495 bp, Artificial Sequence
  Oligonucleotide
gccttgccagcccgctcagatcttcgtgtctcctactccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgtctcctagtcgacaatgaaaaactgttttttggcagtggaacccagctctctgtcttgggtatgtaaaagacttctttcgggatagtgtatcataaggtcggagttccaggagatcttcgtgtctcctactgatggcgcgagggaggc

SEQ ID NO: 3473 - DNA, 495 bp, Artificial Sequence
  Oligonucleotide
gccttgccagcccgctcagatcttcgtagagtgtcctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtagagtgtcgtcgacatcagccccagcattttggtgatgggactcgactctccatcctaggtaagttgcagaatcagggtggtatggccattgtcccttgaaggcagagttctctatcttcgtagagtgtcctgatggcgcgagggaggc

SEQ ID NO: 3474 - DNA, 495 bp, Artificial Sequence
  Oligonucleotide
gccttgccagcccgctcagatcttcgtgttccgaactccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgttccgaagtcgacataattcacccctccactttgggaacgggaccaggctcactgtgacaggtatgggggctccactcttgactcgggggtgcctgggtttgactgcaatgatatcttcgtgttccgaactgatggcgcgagggaggc

SEQ ID NO: 3475 - DNA, 495 bp, Artificial Sequence
  Oligonucleotide
gccttgccagcccgctcagatcttcgtcgttacttctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtcgttacttgtcgacacaatgagcagttcttcgggccagggacacggctcaccgtgctaggtaagaagggggctccaggtgggagagagggtgagcagcccagcctgcacgacccatcttcgtcgttacttctgatggcgcgagggaggc

SEQ ID NO: 3476 - DNA, 495 bp, Artificial Sequence
  Oligonucleotide
gccttgccagcccgctcagatcttcgttaggagacctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgttaggagacgtcgacaccggggagctgttttttggagaaggctctaggctgaccgtactgggtaaggaggcggttggggctccggagagctccgagagggcgggatgggcagaggatcttcgttaggagacctgatggcgcgagggaggc

SEQ ID NO: 3477 - DNA, 495 bp, Artificial Sequence
  Oligonucleotide
gccttgccagcccgctcagatcttcgtgtgtctacctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgtgtctacgtcgacagatacgcagtattttggcccaggcacccggctgacagtgctcggtaagcgggggctcccgctgaagccccggaactggggagggggcgccccgggacgcatcttcgtgtgtctacctgatggcgcgagggaggc

SEQ ID NO: 3478 - DNA, 495 bp, Artificial Sequence
  Oligonucleotide
gccttgccagcccgctcagatcttcgtgtacagtgctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtgtacagtggtcgacaaaacattcagtacttcggcgccgggacccggctctcagtgctgggtaagctggggccgccgggggaccggggacgagactgcgctcgggtttttgtgcgatcttcgtgtacagtgctgatggcgcgagggaggc

SEQ ID NO: 3479 - DNA, 495 bp, Artificial Sequence
  Oligonucleotide
gccttgccagcccgctcagatcttcgtggatcatcctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtggatcatcgtcgacgagacccagtacttcgggccaggcacgcggctcctggtgctcggtgagcgcgggctgctggggcgcgggcgcgggcggcttgggtctggtttttgcggggatcttcgtggatcatcctgatggcgcgagggaggc

SEQ ID NO: 3480 - DNA, 495 bp, Artificial Sequence
  Oligonucleotide
gccttgccagcccgctcagatcttcgttattggcgctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgttattggcggtcgacgggccaacgtcctgactttcggggccggcagcaggctgaccgtgctgggtgagttttcgcgggaccacccgggcggcgggattcaggtggaaggcggcggatcttcgttattggcgctgatggcgcgagggaggc

SEQ ID NO: 3481 - DNA, 495 bp, Artificial Sequence
  Oligonucleotide
gccttgccagcccgctcagatcttcgtaggcttgactccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagtgaatcttcgtaggcttgagtcgacacgagcagtacttcgggccgggcaccaggctcacggtcacaggtgagattcgggcgtctccccaccttccagcccctcggtccccggagtcggagggtggatcttcgtaggcttgactgatggcgcgagggaggc

SEQ ID NO: 3482 - DNA, 495 bp, Artificial Sequence
  Oligonucleotide
gccttgccagcccgctcagtccacagtgacactctctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgacactctgtcgacactgaagctttctttggacaaggcaccagactcacagttgtaggtaagacatttttcaggttcttttgcagatccgtcacagggaaaagtgggtccacagtccacagtgacactctctgatggcgcgagggaggc

SEQ ID NO: 3483 - DNA, 495 bp, Artificial Sequence
  Oligonucleotide
gccttgccagcccgctcagtccacagtttcggaacctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtttcggaacgtcgactatggctacaccttcggttcggggaccaggttaaccgttgtaggtaaggctgggggtctctaggaggggtgcgatgagggaggactctgtcctgggaaattccacagtttcggaacctgatggcgcgagggaggc

SEQ ID NO: 3484 - DNA, 495 bp, Artificial Sequence
  Oligonucleotide
gccttgccagcccgctcagtccacagtaagtaacgctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtaagtaacggtcgacgaaacaccatatattttggagagggaagttggctcactgttgtaggtgagtaagtcaaggctggacagctgggaacttgcaaaaaggggctggaatccagtccacagtaagtaacgctgatggcgcgagggaggc

SEQ ID NO: 3485 - DNA, 495 bp, Artificial Sequence
  Oligonucleotide
gccttgccagcccgctcagtccacagtgtctcctactccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgtctcctagtcgacaatgaaaaactgttttttggcagtggaacccagctctctgtcttgggtatgtaaaagacttctttcgggatagtgtatcataaggtcggagttccaggagtccacagtgtctcctactgatggcgcgagggaggc

SEQ ID NO: 3486 - DNA, 495 bp, Artificial Sequence
  Oligonucleotide
gccttgccagcccgctcagtccacagtagagtgtcctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtagagtgtcgtcgacatcagccccagcattttggtgatgggactcgactctccatcctaggtaagttgcagaatcagggtggtatggccattgtcccttgaaggcagagttctcttccacagtagagtgtcctgatggcgcgagggaggc

SEQ ID NO: 3487 - DNA, 495 bp, Artificial Sequence
  Oligonucleotide
gccttgccagcccgctcagtccacagtgttccgaactccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgttccgaagtcgacataattcacccctccactttgggaacgggaccaggctcactgtgacaggtatgggggctccactcttgactcgggggtgcctgggtttgactgcaatgattccacagtgttccgaactgatggcgcgagggaggc

SEQ ID NO: 3488 - DNA, 495 bp, Artificial Sequence
  Oligonucleotide
gccttgccagcccgctcagtccacagtcgttacttctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtcgttacttgtcgacacaatgagcagttcttcgggccagggacacggctcaccgtgctaggtaagaagggggctccaggtgggagagagggtgagcagcccagcctgcacgaccctccacagtcgttacttctgatggcgcgagggaggc

SEQ ID NO: 3489 - DNA, 495 bp, Artificial Sequence
  Oligonucleotide
gccttgccagcccgctcagtccacagttaggagacctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagttaggagacgtcgacaccggggagctgttttttggagaaggctctaggctgaccgtactgggtaaggaggcggttggggctccggagagctccgagagggcgggatgggcagaggtccacagttaggagacctgatggcgcgagggaggc

SEQ ID NO: 3490 - DNA, 495 bp, Artificial Sequence
  Oligonucleotide
gccttgccagcccgctcagtccacagtgtgtctacctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgtgtctacgtcgacagatacgcagtattttggcccaggcacccggctgacagtgctcggtaagcgggggctcccgctgaagccccggaactggggagggggcgccccgggacgctccacagtgtgtctacctgatggcgcgagggaggc

SEQ ID NO: 3491 - DNA, 495 bp, Artificial Sequence
  Oligonucleotide
gccttgccagcccgctcagtccacagtgtacagtgctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtgtacagtggtcgacaaaacattcagtacttcggcgccgggacccggctctcagtgctgggtaagctggggccgccgggggaccggggacgagactgcgctcgggtttttgtgcgtccacagtgtacagtgctgatggcgcgagggaggc

SEQ ID NO: 3492 - DNA, 495 bp, Artificial Sequence
  Oligonucleotide
gccttgccagcccgctcagtccacagtggatcatcctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtggatcatcgtcgacgagacccagtacttcgggccaggcacgcggctcctggtgctcggtgagcgcgggctgctggggcgcgggcgcgggcggcttgggtctggtttttgcggggtccacagtggatcatcctgatggcgcgagggaggc

SEQ ID NO: 3493 - DNA, 495 bp, Artificial Sequence
  Oligonucleotide
gccttgccagcccgctcagtccacagttattggcgctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagttattggcggtcgacgggccaacgtcctgactttcggggccggcagcaggctgaccgtgctgggtgagttttcgcgggaccacccgggcggcgggattcaggtggaaggcggcggtccacagttattggcgctgatggcgcgagggaggc

SEQ ID NO: 3494 - DNA, 495 bp, Artificial Sequence
  Oligonucleotide
gccttgccagcccgctcagtccacagtaggcttgactccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagtgatccacagtaggcttgagtcgacacgagcagtacttcgggccgggcaccaggctcacggtcacaggtgagattcgggcgtctccccaccttccagcccctcggtccccggagtcggagggtggtccacagtaggcttgactgatggcgcgagggaggc

SEQ ID NO: 3495 - DNA, 495 bp, Artificial Sequence
  Oligonucleotide
gccttgccagcccgctcagatgacaccgacactctttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgacactctgtcgacactgaagctttctttggacaaggcaccagactcacagttgtaggtaagacatttttcaggttcttttgcagatccgtcacagggaaaagtgggtccacagatgacaccgacactctctgatggcgcgagggaggc

SEQ ID NO: 3496 - DNA, 495 bp, Artificial Sequence
  Oligonucleotide
gccttgccagcccgctcagatgacaccttcggaacttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccttcggaacgtcgactatggctacaccttcggttcggggaccaggttaaccgttgtaggtaaggctgggggtctctaggaggggtgcgatgagggaggactctgtcctgggaaatatgacaccttcggaacctgatggcgcgagggaggc

SEQ ID NO: 3497 - DNA, 495 bp, Artificial Sequence
  Oligonucleotide
gccttgccagcccgctcagatgacaccaagtaacgttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccaagtaacggtcgacgaaacaccatatattttggagagggaagttggctcactgttgtaggtgagtaagtcaaggctggacagctgggaacttgcaaaaaggggctggaatccagatgacaccaagtaacgctgatggcgcgagggaggc

SEQ ID NO: 3498 - DNA, 495 bp, Artificial Sequence
  Oligonucleotide
gccttgccagcccgctcagatgacaccgtctcctattccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgtctcctagtcgacaatgaaaaactgttttttggcagtggaacccagctctctgtcttgggtatgtaaaagacttctttcgggatagtgtatcataaggtcggagttccaggagatgacaccgtctcctactgatggcgcgagggaggc

SEQ ID NO: 3499 - DNA, 495 bp, Artificial Sequence
  Oligonucleotide
gccttgccagcccgctcagatgacaccagagtgtcttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccagagtgtcgtcgacatcagccccagcattttggtgatgggactcgactctccatcctaggtaagttgcagaatcagggtggtatggccattgtcccttgaaggcagagttctctatgacaccagagtgtcctgatggcgcgagggaggc

SEQ ID NO: 3500 - DNA, 495 bp, Artificial Sequence
  Oligonucleotide
gccttgccagcccgctcagatgacaccgttccgaattccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgttccgaagtcgacataattcacccctccactttgggaacgggaccaggctcactgtgacaggtatgggggctccactcttgactcgggggtgcctgggtttgactgcaatgatatgacaccgttccgaactgatggcgcgagggaggc

SEQ ID NO: 3501 - DNA, 495 bp, Artificial Sequence
  Oligonucleotide
gccttgccagcccgctcagatgacacccgttacttttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacacccgttacttgtcgacacaatgagcagttcttcgggccagggacacggctcaccgtgctaggtaagaagggggctccaggtgggagagagggtgagcagcccagcctgcacgacccatgacacccgttacttctgatggcgcgagggaggc

SEQ ID NO: 3502 - DNA, 495 bp, Artificial Sequence
  Oligonucleotide
gccttgccagcccgctcagatgacacctaggagacttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacacctaggagacgtcgacaccggggagctgttttttggagaaggctctaggctgaccgtactgggtaaggaggcggttggggctccggagagctccgagagggcgggatgggcagaggatgacacctaggagacctgatggcgcgagggaggc

SEQ ID NO: 3503 - DNA, 495 bp, Artificial Sequence
  Oligonucleotide
gccttgccagcccgctcagatgacaccgtgtctacttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgtgtctacgtcgacagatacgcagtattttggcccaggcacccggctgacagtgctcggtaagcgggggctcccgctgaagccccggaactggggagggggcgccccgggacgcatgacaccgtgtctacctgatggcgcgagggaggc

SEQ ID NO: 3504 - DNA, 495 bp, Artificial Sequence
  Oligonucleotide
gccttgccagcccgctcagatgacaccgtacagtgttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccgtacagtggtcgacaaaacattcagtacttcggcgccgggacccggctctcagtgctgggtaagctggggccgccgggggaccggggacgagactgcgctcgggtttttgtgcgatgacaccgtacagtgctgatggcgcgagggaggc

SEQ ID NO: 3505 - DNA, 495 bp, Artificial Sequence
  Oligonucleotide
gccttgccagcccgctcagatgacaccggatcatcttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccggatcatcgtcgacgagacccagtacttcgggccaggcacgcggctcctggtgctcggtgagcgcgggctgctggggcgcgggcgcgggcggcttgggtctggtttttgcggggatgacaccggatcatcctgatggcgcgagggaggc

SEQ ID NO: 3506 - DNA, 495 bp, Artificial Sequence
  Oligonucleotide
gccttgccagcccgctcagatgacacctattggcgttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacacctattggcggtcgacgggccaacgtcctgactttcggggccggcagcaggctgaccgtgctgggtgagttttcgcgggaccacccgggcggcgggattcaggtggaaggcggcggatgacacctattggcgctgatggcgcgagggaggc

SEQ ID NO: 3507 - DNA, 495 bp, Artificial Sequence
  Oligonucleotide
gccttgccagcccgctcagatgacaccaggcttgattccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagtgaatgacaccaggcttgagtcgacacgagcagtacttcgggccgggcaccaggctcacggtcacaggtgagattcgggcgtctccccaccttccagcccctcggtccccggagtcggagggtggatgacaccaggcttgactgatggcgcgagggaggc

SEQ ID NO: 3508 - DNA, 495 bp, Artificial Sequence
  Oligonucleotide
gccttgccagcccgctcagcttcacgagacactcttttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagacactctgtcgacactgaagctttctttggacaaggcaccagactcacagttgtaggtaagacatttttcaggttcttttgcagatccgtcacagggaaaagtgggtccacagcttcacgagacactctctgatggcgcgagggaggc

SEQ ID NO: 3509 - DNA, 495 bp, Artificial Sequence
  Oligonucleotide
gccttgccagcccgctcagcttcacgattcggaactttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgattcggaacgtcgactatggctacaccttcggttcggggaccaggttaaccgttgtaggtaaggctgggggtctctaggaggggtgcgatgagggaggactctgtcctgggaaatcttcacgattcggaacctgatggcgcgagggaggc

SEQ ID NO: 3510 - DNA, 495 bp, Artificial Sequence
  Oligonucleotide
gccttgccagcccgctcagcttcacgaaagtaacgtttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaaagtaacggtcgacgaaacaccatatattttggagagggaagttggctcactgttgtaggtgagtaagtcaaggctggacagctgggaacttgcaaaaaggggctggaatccagcttcacgaaagtaacgctgatggcgcgagggaggc

SEQ ID NO: 3511 - DNA, 495 bp, Artificial Sequence
  Oligonucleotide
gccttgccagcccgctcagcttcacgagtctcctatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagtctcctagtcgacaatgaaaaactgttttttggcagtggaacccagctctctgtcttgggtatgtaaaagacttctttcgggatagtgtatcataaggtcggagttccaggagcttcacgagtctcctactgatggcgcgagggaggc

SEQ ID NO: 3512 - DNA, 495 bp, Artificial Sequence
  Oligonucleotide
gccttgccagcccgctcagcttcacgaagagtgtctttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaagagtgtcgtcgacatcagccccagcattttggtgatgggactcgactctccatcctaggtaagttgcagaatcagggtggtatggccattgtcccttgaaggcagagttctctcttcacgaagagtgtcctgatggcgcgagggaggc

SEQ ID NO: 3513 - DNA, 495 bp, Artificial Sequence
  Oligonucleotide
gccttgccagcccgctcagcttcacgagttccgaatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagttccgaagtcgacataattcacccctccactttgggaacgggaccaggctcactgtgacaggtatgggggctccactcttgactcgggggtgcctgggtttgactgcaatgatcttcacgagttccgaactgatggcgcgagggaggc

SEQ ID NO: 3514 - DNA, 495 bp, Artificial Sequence
  Oligonucleotide
gccttgccagcccgctcagcttcacgacgttactttttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgacgttacttgtcgacacaatgagcagttcttcgggccagggacacggctcaccgtgctaggtaagaagggggctccaggtgggagagagggtgagcagcccagcctgcacgaccccttcacgacgttacttctgatggcgcgagggaggc

SEQ ID NO: 3515 - DNA, 495 bp, Artificial Sequence
  Oligonucleotide
gccttgccagcccgctcagcttcacgataggagactttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgataggagacgtcgacaccggggagctgttttttggagaaggctctaggctgaccgtactgggtaaggaggcggttggggctccggagagctccgagagggcgggatgggcagaggcttcacgataggagacctgatggcgcgagggaggc

SEQ ID NO: 3516 - DNA, 495 bp, Artificial Sequence
  Oligonucleotide
gccttgccagcccgctcagcttcacgagtgtctactttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagtgtctacgtcgacagatacgcagtattttggcccaggcacccggctgacagtgctcggtaagcgggggctcccgctgaagccccggaactggggagggggcgccccgggacgccttcacgagtgtctacctgatggcgcgagggaggc

SEQ ID NO: 3517 - DNA, 495 bp, Artificial Sequence
  Oligonucleotide
gccttgccagcccgctcagcttcacgagtacagtgtttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgagtacagtggtcgacaaaacattcagtacttcggcgccgggacccggctctcagtgctgggtaagctggggccgccgggggaccggggacgagactgcgctcgggtttttgtgcgcttcacgagtacagtgctgatggcgcgagggaggc

SEQ ID NO: 3518 - DNA, 495 bp, Artificial Sequence
  Oligonucleotide
gccttgccagcccgctcagcttcacgaggatcatctttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaggatcatcgtcgacgagacccagtacttcgggccaggcacgcggctcctggtgctcggtgagcgcgggctgctggggcgcgggcgcgggcggcttgggtctggtttttgcggggcttcacgaggatcatcctgatggcgcgagggaggc

SEQ ID NO: 3519 - DNA, 495 bp, Artificial Sequence
  Oligonucleotide
gccttgccagcccgctcagcttcacgatattggcgtttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgatattggcggtcgacgggccaacgtcctgactttcggggccggcagcaggctgaccgtgctgggtgagttttcgcgggaccacccgggcggcgggattcaggtggaaggcggcggcttcacgatattggcgctgatggcgcgagggaggc

SEQ ID NO: 3520 - DNA, 495 bp, Artificial Sequence
  Oligonucleotide
gccttgccagcccgctcagcttcacgaaggcttgatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagtgacttcacgaaggcttgagtcgacacgagcagtacttcgggccgggcaccaggctcacggtcacaggtgagattcgggcgtctccccaccttccagcccctcggtccccggagtcggagggtggcttcacgaaggcttgactgatggcgcgagggaggc

SEQ ID NO: 3521 - DNA, 495 bp, Artificial Sequence
  Oligonucleotide
gccttgccagcccgctcagagctagtggacactctttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggacactctgtcgacactgaagctttctttggacaaggcaccagactcacagttgtaggtaagacatttttcaggttcttttgcagatccgtcacagggaaaagtgggtccacagagctagtggacactctctgatggcgcgagggaggc

SEQ ID NO: 3522 - DNA, 495 bp, Artificial Sequence
  Oligonucleotide
gccttgccagcccgctcagagctagtgttcggaacttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgttcggaacgtcgactatggctacaccttcggttcggggaccaggttaaccgttgtaggtaaggctgggggtctctaggaggggtgcgatgagggaggactctgtcctgggaaatagctagtgttcggaacctgatggcgcgagggaggc

SEQ ID NO: 3523 - DNA, 495 bp, Artificial Sequence
  Oligonucleotide
gccttgccagcccgctcagagctagtgaagtaacgttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgaagtaacggtcgacgaaacaccatatattttggagagggaagttggctcactgttgtaggtgagtaagtcaaggctggacagctgggaacttgcaaaaaggggctggaatccagagctagtgaagtaacgctgatggcgcgagggaggc

SEQ ID NO: 3524 - DNA, 495 bp, Artificial Sequence
  Oligonucleotide
gccttgccagcccgctcagagctagtggtctcctattccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggtctcctagtcgacaatgaaaaactgttttttggcagtggaacccagctctctgtcttgggtatgtaaaagacttctttcgggatagtgtatcataaggtcggagttccaggagagctagtggtctcctactgatggcgcgagggaggc

SEQ ID NO: 3525 - DNA, 495 bp, Artificial Sequence
  Oligonucleotide
gccttgccagcccgctcagagctagtgagagtgtcttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgagagtgtcgtcgacatcagccccagcattttggtgatgggactcgactctccatcctaggtaagttgcagaatcagggtggtatggccattgtcccttgaaggcagagttctctagctagtgagagtgtcctgatggcgcgagggaggc

SEQ ID NO: 3526 - DNA, 495 bp, Artificial Sequence
  Oligonucleotide
gccttgccagcccgctcagagctagtggttccgaattccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggttccgaagtcgacataattcacccctccactttgggaacgggaccaggctcactgtgacaggtatgggggctccactcttgactcgggggtgcctgggtttgactgcaatgatagctagtggttccgaactgatggcgcgagggaggc

SEQ ID NO: 3527 - DNA, 495 bp, Artificial Sequence
  Oligonucleotide
gccttgccagcccgctcagagctagtgcgttacttttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgcgttacttgtcgacacaatgagcagttcttcgggccagggacacggctcaccgtgctaggtaagaagggggctccaggtgggagagagggtgagcagcccagcctgcacgacccagctagtgcgttacttctgatggcgcgagggaggc

SEQ ID NO: 3528 - DNA, 495 bp, Artificial Sequence
  Oligonucleotide
gccttgccagcccgctcagagctagtgtaggagacttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgtaggagacgtcgacaccggggagctgttttttggagaaggctctaggctgaccgtactgggtaaggaggcggttggggctccggagagctccgagagggcgggatgggcagaggagctagtgtaggagacctgatggcgcgagggaggc

SEQ ID NO: 3529 - DNA, 495 bp, Artificial Sequence
  Oligonucleotide
gccttgccagcccgctcagagctagtggtgtctacttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggtgtctacgtcgacagatacgcagtattttggcccaggcacccggctgacagtgctcggtaagcgggggctcccgctgaagccccggaactggggagggggcgccccgggacgcagctagtggtgtctacctgatggcgcgagggaggc

SEQ ID NO: 3530 - DNA, 495 bp, Artificial Sequence
  Oligonucleotide
gccttgccagcccgctcagagctagtggtacagtgttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtggtacagtggtcgacaaaacattcagtacttcggcgccgggacccggctctcagtgctgggtaagctggggccgccgggggaccggggacgagactgcgctcgggtttttgtgcgagctagtggtacagtgctgatggcgcgagggaggc

SEQ ID NO: 3531 - DNA, 495 bp, Artificial Sequence
  Oligonucleotide
gccttgccagcccgctcagagctagtgggatcatcttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgggatcatcgtcgacgagacccagtacttcgggccaggcacgcggctcctggtgctcggtgagcgcgggctgctggggcgcgggcgcgggcggcttgggtctggtttttgcggggagctagtgggatcatcctgatggcgcgagggaggc

SEQ ID NO: 3532 - DNA, 495 bp, Artificial Sequence
  Oligonucleotide
gccttgccagcccgctcagagctagtgtattggcgttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgtattggcggtcgacgggccaacgtcctgactttcggggccggcagcaggctgaccgtgctgggtgagttttcgcgggaccacccgggcggcgggattcaggtggaaggcggcggagctagtgtattggcgctgatggcgcgagggaggc

SEQ ID NO: 3533 - DNA, 495 bp, Artificial Sequence
  Oligonucleotide
gccttgccagcccgctcagagctagtgaggcttgattccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagtgaagctagtgaggcttgagtcgacacgagcagtacttcgggccgggcaccaggctcacggtcacaggtgagattcgggcgtctccccaccttccagcccctcggtccccggagtcggagggtggagctagtgaggcttgactgatggcgcgagggaggc

SEQ ID NO: 3534 - DNA, 495 bp, Artificial Sequence
  Oligonucleotide
gccttgccagcccgctcagtaaccaaggacactctttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggacactctgtcgacactgaagctttctttggacaaggcaccagactcacagttgtaggtaagacatttttcaggttcttttgcagatccgtcacagggaaaagtgggtccacagtaaccaaggacactctctgatggcgcgagggaggc

SEQ ID NO: 3535 - DNA, 495 bp, Artificial Sequence
  Oligonucleotide
gccttgccagcccgctcagtaaccaagttcggaacttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagttcggaacgtcgactatggctacaccttcggttcggggaccaggttaaccgttgtaggtaaggctgggggtctctaggaggggtgcgatgagggaggactctgtcctgggaaattaaccaagttcggaacctgatggcgcgagggaggc

SEQ ID NO: 3536 - DNA, 495 bp, Artificial Sequence
  Oligonucleotide
gccttgccagcccgctcagtaaccaagaagtaacgttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagaagtaacggtcgacgaaacaccatatattttggagagggaagttggctcactgttgtaggtgagtaagtcaaggctggacagctgggaacttgcaaaaaggggctggaatccagtaaccaagaagtaacgctgatggcgcgagggaggc

SEQ ID NO: 3537 - DNA, 495 bp, Artificial Sequence
  Oligonucleotide
gccttgccagcccgctcagtaaccaaggtctcctattccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggtctcctagtcgacaatgaaaaactgttttttggcagtggaacccagctctctgtcttgggtatgtaaaagacttctttcgggatagtgtatcataaggtcggagttccaggagtaaccaaggtctcctactgatggcgcgagggaggc

SEQ ID NO: 3538 - DNA, 495 bp, Artificial Sequence
  Oligonucleotide
gccttgccagcccgctcagtaaccaagagagtgtcttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagagagtgtcgtcgacatcagccccagcattttggtgatgggactcgactctccatcctaggtaagttgcagaatcagggtggtatggccattgtcccttgaaggcagagttctcttaaccaagagagtgtcctgatggcgcgagggaggc

SEQ ID NO: 3539 - DNA, 495 bp, Artificial Sequence
  Oligonucleotide
gccttgccagcccgctcagtaaccaaggttccgaattccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggttccgaagtcgacataattcacccctccactttgggaacgggaccaggctcactgtgacaggtatgggggctccactcttgactcgggggtgcctgggtttgactgcaatgattaaccaaggttccgaactgatggcgcgagggaggc

SEQ ID NO: 3540 - DNA, 495 bp, Artificial Sequence
  Oligonucleotide
gccttgccagcccgctcagtaaccaagcgttacttttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagcgttacttgtcgacacaatgagcagttcttcgggccagggacacggctcaccgtgctaggtaagaagggggctccaggtgggagagagggtgagcagcccagcctgcacgaccctaaccaagcgttacttctgatggcgcgagggaggc

SEQ ID NO: 3541 - DNA, 495 bp, Artificial Sequence
  Oligonucleotide
gccttgccagcccgctcagtaaccaagtaggagacttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagtaggagacgtcgacaccggggagctgttttttggagaaggctctaggctgaccgtactgggtaaggaggcggttggggctccggagagctccgagagggcgggatgggcagaggtaaccaagtaggagacctgatggcgcgagggaggc

SEQ ID NO: 3542 - DNA, 495 bp, Artificial Sequence
  Oligonucleotide
gccttgccagcccgctcagtaaccaaggtgtctacttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggtgtctacgtcgacagatacgcagtattttggcccaggcacccggctgacagtgctcggtaagcgggggctcccgctgaagccccggaactggggagggggcgccccgggacgctaaccaaggtgtctacctgatggcgcgagggaggc

SEQ ID NO: 3543 - DNA, 495 bp, Artificial Sequence
  Oligonucleotide
gccttgccagcccgctcagtaaccaaggtacagtgttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaaggtacagtggtcgacaaaacattcagtacttcggcgccgggacccggctctcagtgctgggtaagctggggccgccgggggaccggggacgagactgcgctcgggtttttgtgcgtaaccaaggtacagtgctgatggcgcgagggaggc

SEQ ID NO: 3544 - DNA, 495 bp, Artificial Sequence
  Oligonucleotide
gccttgccagcccgctcagtaaccaagggatcatcttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagggatcatcgtcgacgagacccagtacttcgggccaggcacgcggctcctggtgctcggtgagcgcgggctgctggggcgcgggcgcgggcggcttgggtctggtttttgcggggtaaccaagggatcatcctgatggcgcgagggaggc

SEQ ID NO: 3545 - DNA, 495 bp, Artificial Sequence
  Oligonucleotide
gccttgccagcccgctcagtaaccaagtattggcgttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagtattggcggtcgacgggccaacgtcctgactttcggggccggcagcaggctgaccgtgctgggtgagttttcgcgggaccacccgggcggcgggattcaggtggaaggcggcggtaaccaagtattggcgctgatggcgcgagggaggc

SEQ ID NO: 3546 - DNA, 495 bp, Artificial Sequence
  Oligonucleotide
gccttgccagcccgctcagtaaccaagaggcttgattccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagtgataaccaagaggcttgagtcgacacgagcagtacttcgggccgggcaccaggctcacggtcacaggtgagattcgggcgtctccccaccttccagcccctcggtccccggagtcggagggtggtaaccaagaggcttgactgatggcgcgagggaggc

SEQ ID NO: 3547 - DNA, 495 bp, Artificial Sequence
  Oligonucleotide
gccttgccagcccgctcagcaagaggtgacactctttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgacactctgtcgacactgaagctttctttggacaaggcaccagactcacagttgtaggtaagacatttttcaggttcttttgcagatccgtcacagggaaaagtgggtccacagcaagaggtgacactctctgatggcgcgagggaggc

SEQ ID NO: 3548 - DNA, 495 bp, Artificial Sequence
  Oligonucleotide
gccttgccagcccgctcagcaagaggtttcggaacttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtttcggaacgtcgactatggctacaccttcggttcggggaccaggttaaccgttgtaggtaaggctgggggtctctaggaggggtgcgatgagggaggactctgtcctgggaaatcaagaggtttcggaacctgatggcgcgagggaggc

SEQ ID NO: 3549 - DNA, 495 bp, Artificial Sequence
  Oligonucleotide
gccttgccagcccgctcagcaagaggtaagtaacgttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtaagtaacggtcgacgaaacaccatatattttggagagggaagttggctcactgttgtaggtgagtaagtcaaggctggacagctgggaacttgcaaaaaggggctggaatccagcaagaggtaagtaacgctgatggcgcgagggaggc

SEQ ID NO: 3550 - DNA, 495 bp, Artificial Sequence
  Oligonucleotide
gccttgccagcccgctcagcaagaggtgtctcctattccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgtctcctagtcgacaatgaaaaactgttttttggcagtggaacccagctctctgtcttgggtatgtaaaagacttctttcgggatagtgtatcataaggtcggagttccaggagcaagaggtgtctcctactgatggcgcgagggaggc

SEQ ID NO: 3551 - DNA, 495 bp, Artificial Sequence
  Oligonucleotide
gccttgccagcccgctcagcaagaggtagagtgtcttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtagagtgtcgtcgacatcagccccagcattttggtgatgggactcgactctccatcctaggtaagttgcagaatcagggtggtatggccattgtcccttgaaggcagagttctctcaagaggtagagtgtcctgatggcgcgagggaggc

SEQ ID NO: 3552 - DNA, 495 bp, Artificial Sequence
  Oligonucleotide
gccttgccagcccgctcagcaagaggtgttccgaattccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgttccgaagtcgacataattcacccctccactttgggaacgggaccaggctcactgtgacaggtatgggggctccactcttgactcgggggtgcctgggtttgactgcaatgatcaagaggtgttccgaactgatggcgcgagggaggc

SEQ ID NO: 3553 - DNA, 495 bp, Artificial Sequence
  Oligonucleotide
gccttgccagcccgctcagcaagaggtcgttacttttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtcgttacttgtcgacacaatgagcagttcttcgggccagggacacggctcaccgtgctaggtaagaagggggctccaggtgggagagagggtgagcagcccagcctgcacgaccccaagaggtcgttacttctgatggcgcgagggaggc

SEQ ID NO: 3554 - DNA, 495 bp, Artificial Sequence
  Oligonucleotide
gccttgccagcccgctcagcaagaggttaggagacttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggttaggagacgtcgacaccggggagctgttttttggagaaggctctaggctgaccgtactgggtaaggaggcggttggggctccggagagctccgagagggcgggatgggcagaggcaagaggttaggagacctgatggcgcgagggaggc

SEQ ID NO: 3555 - DNA, 495 bp, Artificial Sequence
  Oligonucleotide
gccttgccagcccgctcagcaagaggtgtgtctacttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgtgtctacgtcgacagatacgcagtattttggcccaggcacccggctgacagtgctcggtaagcgggggctcccgctgaagccccggaactggggagggggcgccccgggacgccaagaggtgtgtctacctgatggcgcgagggaggc

SEQ ID NO: 3556 - DNA, 495 bp, Artificial Sequence
  Oligonucleotide
gccttgccagcccgctcagcaagaggtgtacagtgttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtgtacagtggtcgacaaaacattcagtacttcggcgccgggacccggctctcagtgctgggtaagctggggccgccgggggaccggggacgagactgcgctcgggtttttgtgcgcaagaggtgtacagtgctgatggcgcgagggaggc

SEQ ID NO: 3557 - DNA, 495 bp, Artificial Sequence
  Oligonucleotide
gccttgccagcccgctcagcaagaggtggatcatcttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtggatcatcgtcgacgagacccagtacttcgggccaggcacgcggctcctggtgctcggtgagcgcgggctgctggggcgcgggcgcgggcggcttgggtctggtttttgcggggcaagaggtggatcatcctgatggcgcgagggaggc

SEQ ID NO: 3558 - DNA, 495 bp, Artificial Sequence
  Oligonucleotide
gccttgccagcccgctcagcaagaggttattggcgttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggttattggcggtcgacgggccaacgtcctgactttcggggccggcagcaggctgaccgtgctgggtgagttttcgcgggaccacccgggcggcgggattcaggtggaaggcggcggcaagaggttattggcgctgatggcgcgagggaggc

SEQ ID NO: 3559 - DNA, 495 bp, Artificial Sequence
  Oligonucleotide
gccttgccagcccgctcagcaagaggtaggcttgattccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagtgacaagaggtaggcttgagtcgacacgagcagtacttcgggccgggcaccaggctcacggtcacaggtgagattcgggcgtctccccaccttccagcccctcggtccccggagtcggagggtggcaagaggtaggcttgactgatggcgcgagggaggc

SEQ ID NO: 3560 - DNA, 495 bp, Artificial Sequence
  Oligonucleotide
gccttgccagcccgctcagagaatcaggacactctctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggacactctgtcgacactgaagctttctttggacaaggcaccagactcacagttgtaggtaagacatttttcaggttcttttgcagatccgtcacagggaaaagtgggtccacagagaatcaggacactctctgatggcgcgagggaggc

SEQ ID NO: 3561 - DNA, 495 bp, Artificial Sequence
  Oligonucleotide
gccttgccagcccgctcagagaatcagttcggaacctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagttcggaacgtcgactatggctacaccttcggttcggggaccaggttaaccgttgtaggtaaggctgggggtctctaggaggggtgcgatgagggaggactctgtcctgggaaatagaatcagttcggaacctgatggcgcgagggaggc

SEQ ID NO: 3562 - DNA, 495 bp, Artificial Sequence
  Oligonucleotide
gccttgccagcccgctcagagaatcagaagtaacgctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagaagtaacggtcgacgaaacaccatatattttggagagggaagttggctcactgttgtaggtgagtaagtcaaggctggacagctgggaacttgcaaaaaggggctggaatccagagaatcagaagtaacgctgatggcgcgagggaggc

SEQ ID NO: 3563 - DNA, 495 bp, Artificial Sequence
  Oligonucleotide
gccttgccagcccgctcagagaatcaggtctcctactccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggtctcctagtcgacaatgaaaaactgttttttggcagtggaacccagctctctgtcttgggtatgtaaaagacttctttcgggatagtgtatcataaggtcggagttccaggagagaatcaggtctcctactgatggcgcgagggaggc

SEQ ID NO: 3564 - DNA, 495 bp, Artificial Sequence
  Oligonucleotide
gccttgccagcccgctcagagaatcagagagtgtcctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagagagtgtcgtcgacatcagccccagcattttggtgatgggactcgactctccatcctaggtaagttgcagaatcagggtggtatggccattgtcccttgaaggcagagttctctagaatcagagagtgtcctgatggcgcgagggaggc

SEQ ID NO: 3565 - DNA, 495 bp, Artificial Sequence
  Oligonucleotide
gccttgccagcccgctcagagaatcaggttccgaactccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggttccgaagtcgacataattcacccctccactttgggaacgggaccaggctcactgtgacaggtatgggggctccactcttgactcgggggtgcctgggtttgactgcaatgatagaatcaggttccgaactgatggcgcgagggaggc

SEQ ID NO: 3566 - DNA, 495 bp, Artificial Sequence
  Oligonucleotide
gccttgccagcccgctcagagaatcagcgttacttctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagcgttacttgtcgacacaatgagcagttcttcgggccagggacacggctcaccgtgctaggtaagaagggggctccaggtgggagagagggtgagcagcccagcctgcacgacccagaatcagcgttacttctgatggcgcgagggaggc

SEQ ID NO: 3567 - DNA, 495 bp, Artificial Sequence
  Oligonucleotide
gccttgccagcccgctcagagaatcagtaggagacctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagtaggagacgtcgacaccggggagctgttttttggagaaggctctaggctgaccgtactgggtaaggaggcggttggggctccggagagctccgagagggcgggatgggcagaggagaatcagtaggagacctgatggcgcgagggaggc

SEQ ID NO: 3568 - DNA, 495 bp, Artificial Sequence
  Oligonucleotide
gccttgccagcccgctcagagaatcaggtgtctacctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggtgtctacgtcgacagatacgcagtattttggcccaggcacccggctgacagtgctcggtaagcgggggctcccgctgaagccccggaactggggagggggcgccccgggacgcagaatcaggtgtctacctgatggcgcgagggaggc

SEQ ID NO: 3569 - DNA, 495 bp, Artificial Sequence
  Oligonucleotide
gccttgccagcccgctcagagaatcaggtacagtgctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcaggtacagtggtcgacaaaacattcagtacttcggcgccgggacccggctctcagtgctgggtaagctggggccgccgggggaccggggacgagactgcgctcgggtttttgtgcgagaatcaggtacagtgctgatggcgcgagggaggc

SEQ ID NO: 3570 - DNA, 495 bp, Artificial Sequence
  Oligonucleotide
gccttgccagcccgctcagagaatcagggatcatcctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagggatcatcgtcgacgagacccagtacttcgggccaggcacgcggctcctggtgctcggtgagcgcgggctgctggggcgcgggcgcgggcggcttgggtctggtttttgcggggagaatcagggatcatcctgatggcgcgagggaggc

SEQ ID NO: 3571 - DNA, 495 bp, Artificial Sequence
  Oligonucleotide
gccttgccagcccgctcagagaatcagtattggcgctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagtattggcggtcgacgggccaacgtcctgactttcggggccggcagcaggctgaccgtgctgggtgagttttcgcgggaccacccgggcggcgggattcaggtggaaggcggcggagaatcagtattggcgctgatggcgcgagggaggc

SEQ ID NO: 3572 - DNA, 495 bp, Artificial Sequence
  Oligonucleotide
gccttgccagcccgctcagagaatcagaggcttgactccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagtgaagaatcagaggcttgagtcgacacgagcagtacttcgggccgggcaccaggctcacggtcacaggtgagattcgggcgtctccccaccttccagcccctcggtccccggagtcggagggtggagaatcagaggcttgactgatggcgcgagggaggc

SEQ ID NO: 3573 - DNA, 495 bp, Artificial Sequence
  Oligonucleotide
gccttgccagcccgctcagagttgaccgacactctctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgacactctgtcgacactgaagctttctttggacaaggcaccagactcacagttgtaggtaagacatttttcaggttcttttgcagatccgtcacagggaaaagtgggtccacagagttgaccgacactctctgatggcgcgagggaggc

SEQ ID NO: 3574 - DNA, 495 bp, Artificial Sequence
  Oligonucleotide
gccttgccagcccgctcagagttgaccttcggaacctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccttcggaacgtcgactatggctacaccttcggttcggggaccaggttaaccgttgtaggtaaggctgggggtctctaggaggggtgcgatgagggaggactctgtcctgggaaatagttgaccttcggaacctgatggcgcgagggaggc

SEQ ID NO: 3575 - DNA, 495 bp, Artificial Sequence
  Oligonucleotide
gccttgccagcccgctcagagttgaccaagtaacgctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccaagtaacggtcgacgaaacaccatatattttggagagggaagttggctcactgttgtaggtgagtaagtcaaggctggacagctgggaacttgcaaaaaggggctggaatccagagttgaccaagtaacgctgatggcgcgagggaggc

SEQ ID NO: 3576 - DNA, 495 bp, Artificial Sequence
  Oligonucleotide
gccttgccagcccgctcagagttgaccgtctcctactgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgtctcctagtcgacaatgaaaaactgttttttggcagtggaacccagctctctgtcttgggtatgtaaaagacttctttcgggatagtgtatcataaggtcggagttccaggagagttgaccgtctcctactgatggcgcgagggaggc

SEQ ID NO: 3577 - DNA, 495 bp, Artificial Sequence
  Oligonucleotide
gccttgccagcccgctcagagttgaccagagtgtcctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccagagtgtcgtcgacatcagccccagcattttggtgatgggactcgactctccatcctaggtaagttgcagaatcagggtggtatggccattgtcccttgaaggcagagttctctagttgaccagagtgtcctgatggcgcgagggaggc

SEQ ID NO: 3578 - DNA, 495 bp, Artificial Sequence
  Oligonucleotide
gccttgccagcccgctcagagttgaccgttccgaactgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgttccgaagtcgacataattcacccctccactttgggaacgggaccaggctcactgtgacaggtatgggggctccactcttgactcgggggtgcctgggtttgactgcaatgatagttgaccgttccgaactgatggcgcgagggaggc

SEQ ID NO: 3579 - DNA, 495 bp, Artificial Sequence
  Oligonucleotide
gccttgccagcccgctcagagttgacccgttacttctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgacccgttacttgtcgacacaatgagcagttcttcgggccagggacacggctcaccgtgctaggtaagaagggggctccaggtgggagagagggtgagcagcccagcctgcacgacccagttgacccgttacttctgatggcgcgagggaggc

SEQ ID NO: 3580 - DNA, 495 bp, Artificial Sequence
  Oligonucleotide
gccttgccagcccgctcagagttgacctaggagacctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgacctaggagacgtcgacaccggggagctgttttttggagaaggctctaggctgaccgtactgggtaaggaggcggttggggctccggagagctccgagagggcgggatgggcagaggagttgacctaggagacctgatggcgcgagggaggc

SEQ ID NO: 3581 - DNA, 495 bp, Artificial Sequence
  Oligonucleotide
gccttgccagcccgctcagagttgaccgtgtctacctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgtgtctacgtcgacagatacgcagtattttggcccaggcacccggctgacagtgctcggtaagcgggggctcccgctgaagccccggaactggggagggggcgccccgggacgcagttgaccgtgtctacctgatggcgcgagggaggc

SEQ ID NO: 3582 - DNA, 495 bp, Artificial Sequence
  Oligonucleotide
gccttgccagcccgctcagagttgaccgtacagtgctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccgtacagtggtcgacaaaacattcagtacttcggcgccgggacccggctctcagtgctgggtaagctggggccgccgggggaccggggacgagactgcgctcgggtttttgtgcgagttgaccgtacagtgctgatggcgcgagggaggc

SEQ ID NO: 3583 - DNA, 495 bp, Artificial Sequence
  Oligonucleotide
gccttgccagcccgctcagagttgaccggatcatcctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccggatcatcgtcgacgagacccagtacttcgggccaggcacgcggctcctggtgctcggtgagcgcgggctgctggggcgcgggcgcgggcggcttgggtctggtttttgcggggagttgaccggatcatcctgatggcgcgagggaggc

SEQ ID NO: 3584 - DNA, 495 bp, Artificial Sequence
  Oligonucleotide
gccttgccagcccgctcagagttgacctattggcgctgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgacctattggcggtcgacgggccaacgtcctgactttcggggccggcagcaggctgaccgtgctgggtgagttttcgcgggaccacccgggcggcgggattcaggtggaaggcggcggagttgacctattggcgctgatggcgcgagggaggc

SEQ ID NO: 3585 - DNA, 495 bp, Artificial Sequence
  Oligonucleotide
gccttgccagcccgctcagagttgaccaggcttgactgcctgcctctcccacagcccccatggaggcagggatcagccagataccaagatatcacagacacacagggaaaaagatcatcctgaaatttgctcagattaggaaccattattcagtgttctgttatcaataagaccaagaataggggctgaggctgatccattattcaggtagtattggcagcatgaccaaaggcggtgccaaggaagggtacaatgtctctggaaacaaactcaagcattttccctcaaccctggagtctactagcaccagccagacctctgtacctctgtggcagtgaagttgaccaggcttgagtcgacacgagcagtacttcgggccgggcaccaggctcacggtcacaggtgagattcgggcgtctccccaccttccagcccctcggtccccggagtcggagggtggagttgaccaggcttgactgatggcgcgagggaggc

SEQ ID NO: 3586 - DNA, 495 bp, Artificial Sequence
  Oligonucleotide
gccttgccagcccgctcagcgtacgtagacactctttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagacactctgtcgacactgaagctttctttggacaaggcaccagactcacagttgtaggtaagacatttttcaggttcttttgcagatccgtcacagggaaaagtgggtccacagcgtacgtagacactctctgatggcgcgagggaggc

SEQ ID NO: 3587 - DNA, 495 bp, Artificial Sequence
  Oligonucleotide
gccttgccagcccgctcagcgtacgtattcggaacttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtattcggaacgtcgactatggctacaccttcggttcggggaccaggttaaccgttgtaggtaaggctgggggtctctaggaggggtgcgatgagggaggactctgtcctgggaaatcgtacgtattcggaacctgatggcgcgagggaggc

SEQ ID NO: 3588 - DNA, 495 bp, Artificial Sequence
  Oligonucleotide
gccttgccagcccgctcagcgtacgtaaagtaacgttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaaagtaacggtcgacgaaacaccatatattttggagagggaagttggctcactgttgtaggtgagtaagtcaaggctggacagctgggaacttgcaaaaaggggctggaatccagcgtacgtaaagtaacgctgatggcgcgagggaggc

SEQ ID NO: 3589 - DNA, 495 bp, Artificial Sequence
  Oligonucleotide
gccttgccagcccgctcagcgtacgtagtctcctattcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagtctcctagtcgacaatgaaaaactgttttttggcagtggaacccagctctctgtcttgggtatgtaaaagacttctttcgggatagtgtatcataaggtcggagttccaggagcgtacgtagtctcctactgatggcgcgagggaggc

SEQ ID NO: 3590 - DNA, 495 bp, Artificial Sequence
  Oligonucleotide
gccttgccagcccgctcagcgtacgtaagagtgtcttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaagagtgtcgtcgacatcagccccagcattttggtgatgggactcgactctccatcctaggtaagttgcagaatcagggtggtatggccattgtcccttgaaggcagagttctctcgtacgtaagagtgtcctgatggcgcgagggaggc

SEQ ID NO: 3591 - DNA, 495 bp, Artificial Sequence
  Oligonucleotide
gccttgccagcccgctcagcgtacgtagttccgaattcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagttccgaagtcgacataattcacccctccactttgggaacgggaccaggctcactgtgacaggtatgggggctccactcttgactcgggggtgcctgggtttgactgcaatgatcgtacgtagttccgaactgatggcgcgagggaggc

SEQ ID NO: 3592 - DNA, 495 bp, Artificial Sequence
  Oligonucleotide
gccttgccagcccgctcagcgtacgtacgttacttttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtacgttacttgtcgacacaatgagcagttcttcgggccagggacacggctcaccgtgctaggtaagaagggggctccaggtgggagagagggtgagcagcccagcctgcacgaccccgtacgtacgttacttctgatggcgcgagggaggc

SEQ ID NO: 3593 - DNA, 495 bp, Artificial Sequence
  Oligonucleotide
gccttgccagcccgctcagcgtacgtataggagacttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtataggagacgtcgacaccggggagctgttttttggagaaggctctaggctgaccgtactgggtaaggaggcggttggggctccggagagctccgagagggcgggatgggcagaggcgtacgtataggagacctgatggcgcgagggaggc

SEQ ID NO: 3594 - DNA, 495 bp, Artificial Sequence
  Oligonucleotide
gccttgccagcccgctcagcgtacgtagtgtctacttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagtgtctacgtcgacagatacgcagtattttggcccaggcacccggctgacagtgctcggtaagcgggggctcccgctgaagccccggaactggggagggggcgccccgggacgccgtacgtagtgtctacctgatggcgcgagggaggc

SEQ ID NO: 3595 - DNA, 495 bp, Artificial Sequence
  Oligonucleotide
gccttgccagcccgctcagcgtacgtagtacagtgttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtagtacagtggtcgacaaaacattcagtacttcggcgccgggacccggctctcagtgctgggtaagctggggccgccgggggaccggggacgagactgcgctcgggtttttgtgcgcgtacgtagtacagtgctgatggcgcgagggaggc

SEQ ID NO: 3596 - DNA, 495 bp, Artificial Sequence
  Oligonucleotide
gccttgccagcccgctcagcgtacgtaggatcatcttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaggatcatcgtcgacgagacccagtacttcgggccaggcacgcggctcctggtgctcggtgagcgcgggctgctggggcgcgggcgcgggcggcttgggtctggtttttgcggggcgtacgtaggatcatcctgatggcgcgagggaggc

SEQ ID NO: 3597 - DNA, 495 bp, Artificial Sequence
  Oligonucleotide
gccttgccagcccgctcagcgtacgtatattggcgttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtatattggcggtcgacgggccaacgtcctgactttcggggccggcagcaggctgaccgtgctgggtgagttttcgcgggaccacccgggcggcgggattcaggtggaaggcggcggcgtacgtatattggcgctgatggcgcgagggaggc

SEQ ID NO: 3598 - DNA, 495 bp, Artificial Sequence
  Oligonucleotide
gccttgccagcccgctcagcgtacgtaaggcttgattcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagtgacgtacgtaaggcttgagtcgacacgagcagtacttcgggccgggcaccaggctcacggtcacaggtgagattcgggcgtctccccaccttccagcccctcggtccccggagtcggagggtggcgtacgtaaggcttgactgatggcgcgagggaggc

SEQ ID NO: 3599 - DNA, 495 bp, Artificial Sequence
  Oligonucleotide
gccttgccagcccgctcagtcggtactgacactcttctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgacactctgtcgacactgaagctttctttggacaaggcaccagactcacagttgtaggtaagacatttttcaggttcttttgcagatccgtcacagggaaaagtgggtccacagtcggtactgacactctctgatggcgcgagggaggc

SEQ ID NO: 3600 - DNA, 495 bp, Artificial Sequence
  Oligonucleotide
gccttgccagcccgctcagtcggtactttcggaactctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactttcggaacgtcgactatggctacaccttcggttcggggaccaggttaaccgttgtaggtaaggctgggggtctctaggaggggtgcgatgagggaggactctgtcctgggaaattcggtactttcggaacctgatggcgcgagggaggc

SEQ ID NO: 3601 - DNA, 495 bp, Artificial Sequence
  Oligonucleotide
gccttgccagcccgctcagtcggtactaagtaacgtctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactaagtaacggtcgacgaaacaccatatattttggagagggaagttggctcactgttgtaggtgagtaagtcaaggctggacagctgggaacttgcaaaaaggggctggaatccagtcggtactaagtaacgctgatggcgcgagggaggc

SEQ ID NO: 3602 - DNA, 495 bp, Artificial Sequence
  Oligonucleotide
gccttgccagcccgctcagtcggtactgtctcctatctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgtctcctagtcgacaatgaaaaactgttttttggcagtggaacccagctctctgtcttgggtatgtaaaagacttctttcgggatagtgtatcataaggtcggagttccaggagtcggtactgtctcctactgatggcgcgagggaggc

SEQ ID NO: 3603 - DNA, 495 bp, Artificial Sequence
  Oligonucleotide
gccttgccagcccgctcagtcggtactagagtgtctctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactagagtgtcgtcgacatcagccccagcattttggtgatgggactcgactctccatcctaggtaagttgcagaatcagggtggtatggccattgtcccttgaaggcagagttctcttcggtactagagtgtcctgatggcgcgagggaggc

SEQ ID NO: 3604 - DNA, 495 bp, Artificial Sequence
  Oligonucleotide
gccttgccagcccgctcagtcggtactgttccgaatctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgttccgaagtcgacataattcacccctccactttgggaacgggaccaggctcactgtgacaggtatgggggctccactcttgactcgggggtgcctgggtttgactgcaatgattcggtactgttccgaactgatggcgcgagggaggc

SEQ ID NO: 3605 - DNA, 495 bp, Artificial Sequence
  Oligonucleotide
gccttgccagcccgctcagtcggtactcgttactttctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactcgttacttgtcgacacaatgagcagttcttcgggccagggacacggctcaccgtgctaggtaagaagggggctccaggtgggagagagggtgagcagcccagcctgcacgaccctcggtactcgttacttctgatggcgcgagggaggc

SEQ ID NO: 3606 - DNA, 495 bp, Artificial Sequence
  Oligonucleotide
gccttgccagcccgctcagtcggtacttaggagactctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtacttaggagacgtcgacaccggggagctgttttttggagaaggctctaggctgaccgtactgggtaaggaggcggttggggctccggagagctccgagagggcgggatgggcagaggtcggtacttaggagacctgatggcgcgagggaggc

SEQ ID NO: 3607 - DNA, 495 bp, Artificial Sequence
  Oligonucleotide
gccttgccagcccgctcagtcggtactgtgtctactctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgtgtctacgtcgacagatacgcagtattttggcccaggcacccggctgacagtgctcggtaagcgggggctcccgctgaagccccggaactggggagggggcgccccgggacgctcggtactgtgtctacctgatggcgcgagggaggc

SEQ ID NO: 3608 - DNA, 495 bp, Artificial Sequence
  Oligonucleotide
gccttgccagcccgctcagtcggtactgtacagtgtctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactgtacagtggtcgacaaaacattcagtacttcggcgccgggacccggctctcagtgctgggtaagctggggccgccgggggaccggggacgagactgcgctcgggtttttgtgcgtcggtactgtacagtgctgatggcgcgagggaggc

SEQ ID NO: 3609 - DNA, 495 bp, Artificial Sequence
  Oligonucleotide
gccttgccagcccgctcagtcggtactggatcatctctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactggatcatcgtcgacgagacccagtacttcgggccaggcacgcggctcctggtgctcggtgagcgcgggctgctggggcgcgggcgcgggcggcttgggtctggtttttgcggggtcggtactggatcatcctgatggcgcgagggaggc

SEQ ID NO: 3610 - DNA, 495 bp, Artificial Sequence
  Oligonucleotide
gccttgccagcccgctcagtcggtacttattggcgtctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtacttattggcggtcgacgggccaacgtcctgactttcggggccggcagcaggctgaccgtgctgggtgagttttcgcgggaccacccgggcggcgggattcaggtggaaggcggcggtcggtacttattggcgctgatggcgcgagggaggc

SEQ ID NO: 3611 - DNA, 495 bp, Artificial Sequence
  Oligonucleotide
gccttgccagcccgctcagtcggtactaggcttgatctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcatgatcggtactaggcttgagtcgacacgagcagtacttcgggccgggcaccaggctcacggtcacaggtgagattcgggcgtctccccaccttccagcccctcggtccccggagtcggagggtggtcggtactaggcttgactgatggcgcgagggaggc

SEQ ID NO: 3612 - DNA, 495 bp, Artificial Sequence
  Oligonucleotide
gccttgccagcccgctcagccatggatgacactctctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgacactctgtcgacactgaagctttctttggacaaggcaccagactcacagttgtaggtaagacatttttcaggttcttttgcagatccgtcacagggaaaagtgggtccacagccatggatgacactctctgatggcgcgagggaggc

SEQ ID NO: 3613 - DNA, 495 bp, Artificial Sequence
  Oligonucleotide
gccttgccagcccgctcagccatggatttcggaacctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatttcggaacgtcgactatggctacaccttcggttcggggaccaggttaaccgttgtaggtaaggctgggggtctctaggaggggtgcgatgagggaggactctgtcctgggaaatccatggatttcggaacctgatggcgcgagggaggc

SEQ ID NO: 3614 - DNA, 495 bp, Artificial Sequence
  Oligonucleotide
gccttgccagcccgctcagccatggataagtaacgctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggataagtaacggtcgacgaaacaccatatattttggagagggaagttggctcactgttgtaggtgagtaagtcaaggctggacagctgggaacttgcaaaaaggggctggaatccagccatggataagtaacgctgatggcgcgagggaggc

SEQ ID NO: 3615 - DNA, 495 bp, Artificial Sequence
  Oligonucleotide
gccttgccagcccgctcagccatggatgtctcctactctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgtctcctagtcgacaatgaaaaactgttttttggcagtggaacccagctctctgtcttgggtatgtaaaagacttctttcgggatagtgtatcataaggtcggagttccaggagccatggatgtctcctactgatggcgcgagggaggc

SEQ ID NO: 3616 - DNA, 495 bp, Artificial Sequence
  Oligonucleotide
gccttgccagcccgctcagccatggatagagtgtcctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatagagtgtcgtcgacatcagccccagcattttggtgatgggactcgactctccatcctaggtaagttgcagaatcagggtggtatggccattgtcccttgaaggcagagttctctccatggatagagtgtcctgatggcgcgagggaggc

SEQ ID NO: 3617 - DNA, 495 bp, Artificial Sequence
  Oligonucleotide
gccttgccagcccgctcagccatggatgttccgaactctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgttccgaagtcgacataattcacccctccactttgggaacgggaccaggctcactgtgacaggtatgggggctccactcttgactcgggggtgcctgggtttgactgcaatgatccatggatgttccgaactgatggcgcgagggaggc

SEQ ID NO: 3618 - DNA, 495 bp, Artificial Sequence
  Oligonucleotide
gccttgccagcccgctcagccatggatcgttacttctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatcgttacttgtcgacacaatgagcagttcttcgggccagggacacggctcaccgtgctaggtaagaagggggctccaggtgggagagagggtgagcagcccagcctgcacgacccccatggatcgttacttctgatggcgcgagggaggc

SEQ ID NO: 3619 - DNA, 495 bp, Artificial Sequence
  Oligonucleotide
gccttgccagcccgctcagccatggattaggagacctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggattaggagacgtcgacaccggggagctgttttttggagaaggctctaggctgaccgtactgggtaaggaggcggttggggctccggagagctccgagagggcgggatgggcagaggccatggattaggagacctgatggcgcgagggaggc

SEQ ID NO: 3620 - DNA, 495 bp, Artificial Sequence
  Oligonucleotide
gccttgccagcccgctcagccatggatgtgtctacctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgtgtctacgtcgacagatacgcagtattttggcccaggcacccggctgacagtgctcggtaagcgggggctcccgctgaagccccggaactggggagggggcgccccgggacgcccatggatgtgtctacctgatggcgcgagggaggc

SEQ ID NO: 3621 - DNA, 495 bp, Artificial Sequence
  Oligonucleotide
gccttgccagcccgctcagccatggatgtacagtgctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatgtacagtggtcgacaaaacattcagtacttcggcgccgggacccggctctcagtgctgggtaagctggggccgccgggggaccggggacgagactgcgctcgggtttttgtgcgccatggatgtacagtgctgatggcgcgagggaggc

SEQ ID NO: 3622 - DNA, 495 bp, Artificial Sequence
  Oligonucleotide
gccttgccagcccgctcagccatggatggatcatcctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggatggatcatcgtcgacgagacccagtacttcgggccaggcacgcggctcctggtgctcggtgagcgcgggctgctggggcgcgggcgcgggcggcttgggtctggtttttgcggggccatggatggatcatcctgatggcgcgagggaggc

SEQ ID NO: 3623 - DNA, 495 bp, Artificial Sequence
  Oligonucleotide
gccttgccagcccgctcagccatggattattggcgctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggattattggcggtcgacgggccaacgtcctgactttcggggccggcagcaggctgaccgtgctgggtgagttttcgcgggaccacccgggcggcgggattcaggtggaaggcggcggccatggattattggcgctgatggcgcgagggaggc

SEQ ID NO: 3624 - DNA, 495 bp, Artificial Sequence
  Oligonucleotide
gccttgccagcccgctcagccatggataggcttgactctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgaccatggataggcttgagtcgacacgagcagtacttcgggccgggcaccaggctcacggtcacaggtgagattcgggcgtctccccaccttccagcccctcggtccccggagtcggagggtggccatggataggcttgactgatggcgcgagggaggc

SEQ ID NO: 3625 - DNA, 495 bp, Artificial Sequence
  Oligonucleotide
gccttgccagcccgctcagactgctacgacactctctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgacactctgtcgacactgaagctttctttggacaaggcaccagactcacagttgtaggtaagacatttttcaggttcttttgcagatccgtcacagggaaaagtgggtccacagactgctacgacactctctgatggcgcgagggaggc

SEQ ID NO: 3626 - DNA, 495 bp, Artificial Sequence
  Oligonucleotide
gccttgccagcccgctcagactgctacttcggaacctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacttcggaacgtcgactatggctacaccttcggttcggggaccaggttaaccgttgtaggtaaggctgggggtctctaggaggggtgcgatgagggaggactctgtcctgggaaatactgctacttcggaacctgatggcgcgagggaggc

SEQ ID NO: 3627 - DNA, 495 bp, Artificial Sequence
  Oligonucleotide
gccttgccagcccgctcagactgctacaagtaacgctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacaagtaacggtcgacgaaacaccatatattttggagagggaagttggctcactgttgtaggtgagtaagtcaaggctggacagctgggaacttgcaaaaaggggctggaatccagactgctacaagtaacgctgatggcgcgagggaggc

SEQ ID NO: 3628 - DNA, 495 bp, Artificial Sequence
  Oligonucleotide
gccttgccagcccgctcagactgctacgtctcctactctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgtctcctagtcgacaatgaaaaactgttttttggcagtggaacccagctctctgtcttgggtatgtaaaagacttctttcgggatagtgtatcataaggtcggagttccaggagactgctacgtctcctactgatggcgcgagggaggc

SEQ ID NO: 3629 - DNA, 495 bp, Artificial Sequence
  Oligonucleotide
gccttgccagcccgctcagactgctacagagtgtcctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacagagtgtcgtcgacatcagccccagcattttggtgatgggactcgactctccatcctaggtaagttgcagaatcagggtggtatggccattgtcccttgaaggcagagttctctactgctacagagtgtcctgatggcgcgagggaggc

SEQ ID NO: 3630 - DNA, 495 bp, Artificial Sequence
  Oligonucleotide
gccttgccagcccgctcagactgctacgttccgaactctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgttccgaagtcgacataattcacccctccactttgggaacgggaccaggctcactgtgacaggtatgggggctccactcttgactcgggggtgcctgggtttgactgcaatgatactgctacgttccgaactgatggcgcgagggaggc

SEQ ID NO: 3631 - DNA, 495 bp, Artificial Sequence
  Oligonucleotide
gccttgccagcccgctcagactgctaccgttacttctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctaccgttacttgtcgacacaatgagcagttcttcgggccagggacacggctcaccgtgctaggtaagaagggggctccaggtgggagagagggtgagcagcccagcctgcacgacccactgctaccgttacttctgatggcgcgagggaggc

SEQ ID NO: 3632 - DNA, 495 bp, Artificial Sequence
  Oligonucleotide
gccttgccagcccgctcagactgctactaggagacctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctactaggagacgtcgacaccggggagctgttttttggagaaggctctaggctgaccgtactgggtaaggaggcggttggggctccggagagctccgagagggcgggatgggcagaggactgctactaggagacctgatggcgcgagggaggc

SEQ ID NO: 3633 - DNA, 495 bp, Artificial Sequence
  Oligonucleotide
gccttgccagcccgctcagactgctacgtgtctacctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgtgtctacgtcgacagatacgcagtattttggcccaggcacccggctgacagtgctcggtaagcgggggctcccgctgaagccccggaactggggagggggcgccccgggacgcactgctacgtgtctacctgatggcgcgagggaggc

SEQ ID NO: 3634 - DNA, 495 bp, Artificial Sequence
  Oligonucleotide
gccttgccagcccgctcagactgctacgtacagtgctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacgtacagtggtcgacaaaacattcagtacttcggcgccgggacccggctctcagtgctgggtaagctggggccgccgggggaccggggacgagactgcgctcgggtttttgtgcgactgctacgtacagtgctgatggcgcgagggaggc

SEQ ID NO: 3635 - DNA, 495 bp, Artificial Sequence
  Oligonucleotide
gccttgccagcccgctcagactgctacggatcatcctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacggatcatcgtcgacgagacccagtacttcgggccaggcacgcggctcctggtgctcggtgagcgcgggctgctggggcgcgggcgcgggcggcttgggtctggtttttgcggggactgctacggatcatcctgatggcgcgagggaggc

SEQ ID NO: 3636 - DNA, 495 bp, Artificial Sequence
  Oligonucleotide
gccttgccagcccgctcagactgctactattggcgctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctactattggcggtcgacgggccaacgtcctgactttcggggccggcagcaggctgaccgtgctgggtgagttttcgcgggaccacccgggcggcgggattcaggtggaaggcggcggactgctactattggcgctgatggcgcgagggaggc

SEQ ID NO: 3637 - DNA, 495 bp, Artificial Sequence
  Oligonucleotide
gccttgccagcccgctcagactgctacaggcttgactctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgaactgctacaggcttgagtcgacacgagcagtacttcgggccgggcaccaggctcacggtcacaggtgagattcgggcgtctccccaccttccagcccctcggtccccggagtcggagggtggactgctacaggcttgactgatggcgcgagggaggc

SEQ ID NO: 3638 - DNA, 495 bp, Artificial Sequence
  Oligonucleotide
gccttgccagcccgctcagacgaagatgacactctttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgacactctgtcgacactgaagctttctttggacaaggcaccagactcacagttgtaggtaagacatttttcaggttcttttgcagatccgtcacagggaaaagtgggtccacagacgaagatgacactctctgatggcgcgagggaggc

SEQ ID NO: 3639 - DNA, 495 bp, Artificial Sequence
  Oligonucleotide
gccttgccagcccgctcagacgaagatttcggaacttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatttcggaacgtcgactatggctacaccttcggttcggggaccaggttaaccgttgtaggtaaggctgggggtctctaggaggggtgcgatgagggaggactctgtcctgggaaatacgaagatttcggaacctgatggcgcgagggaggc

SEQ ID NO: 3640 - DNA, 495 bp, Artificial Sequence
  Oligonucleotide
gccttgccagcccgctcagacgaagataagtaacgttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagataagtaacggtcgacgaaacaccatatattttggagagggaagttggctcactgttgtaggtgagtaagtcaaggctggacagctgggaacttgcaaaaaggggctggaatccagacgaagataagtaacgctgatggcgcgagggaggc

SEQ ID NO: 3641 - DNA, 495 bp, Artificial Sequence
  Oligonucleotide
gccttgccagcccgctcagacgaagatgtctcctattctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgtctcctagtcgacaatgaaaaactgttttttggcagtggaacccagctctctgtcttgggtatgtaaaagacttctttcgggatagtgtatcataaggtcggagttccaggagacgaagatgtctcctactgatggcgcgagggaggc

SEQ ID NO: 3642 - DNA, 495 bp, Artificial Sequence
  Oligonucleotide
gccttgccagcccgctcagacgaagatagagtgtcttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatagagtgtcgtcgacatcagccccagcattttggtgatgggactcgactctccatcctaggtaagttgcagaatcagggtggtatggccattgtcccttgaaggcagagttctctacgaagatagagtgtcctgatggcgcgagggaggc

SEQ ID NO: 3643 - DNA, 495 bp, Artificial Sequence
  Oligonucleotide
gccttgccagcccgctcagacgaagatgttccgaattctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgttccgaagtcgacataattcacccctccactttgggaacgggaccaggctcactgtgacaggtatgggggctccactcttgactcgggggtgcctgggtttgactgcaatgatacgaagatgttccgaactgatggcgcgagggaggc

SEQ ID NO: 3644 - DNA, 495 bp, Artificial Sequence
  Oligonucleotide
gccttgccagcccgctcagacgaagatcgttacttttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatcgttacttgtcgacacaatgagcagttcttcgggccagggacacggctcaccgtgctaggtaagaagggggctccaggtgggagagagggtgagcagcccagcctgcacgacccacgaagatcgttacttctgatggcgcgagggaggc

SEQ ID NO: 3645 - DNA, 495 bp, Artificial Sequence
  Oligonucleotide
gccttgccagcccgctcagacgaagattaggagacttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagattaggagacgtcgacaccggggagctgttttttggagaaggctctaggctgaccgtactgggtaaggaggcggttggggctccggagagctccgagagggcgggatgggcagaggacgaagattaggagacctgatggcgcgagggaggc

SEQ ID NO: 3646 - DNA, 495 bp, Artificial Sequence
  Oligonucleotide
gccttgccagcccgctcagacgaagatgtgtctacttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgtgtctacgtcgacagatacgcagtattttggcccaggcacccggctgacagtgctcggtaagcgggggctcccgctgaagccccggaactggggagggggcgccccgggacgcacgaagatgtgtctacctgatggcgcgagggaggc

SEQ ID NO: 3647 - DNA, 495 bp, Artificial Sequence
  Oligonucleotide
gccttgccagcccgctcagacgaagatgtacagtgttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatgtacagtggtcgacaaaacattcagtacttcggcgccgggacccggctctcagtgctgggtaagctggggccgccgggggaccggggacgagactgcgctcgggtttttgtgcgacgaagatgtacagtgctgatggcgcgagggaggc

SEQ ID NO: 3648 - DNA, 495 bp, Artificial Sequence
  Oligonucleotide
gccttgccagcccgctcagacgaagatggatcatcttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagatggatcatcgtcgacgagacccagtacttcgggccaggcacgcggctcctggtgctcggtgagcgcgggctgctggggcgcgggcgcgggcggcttgggtctggtttttgcggggacgaagatggatcatcctgatggcgcgagggaggc

SEQ ID NO: 3649 - DNA, 495 bp, Artificial Sequence
  Oligonucleotide
gccttgccagcccgctcagacgaagattattggcgttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagattattggcggtcgacgggccaacgtcctgactttcggggccggcagcaggctgaccgtgctgggtgagttttcgcgggaccacccgggcggcgggattcaggtggaaggcggcggacgaagattattggcgctgatggcgcgagggaggc

SEQ ID NO: 3650 - DNA, 495 bp, Artificial Sequence
  Oligonucleotide
gccttgccagcccgctcagacgaagataggcttgattctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgaacgaagataggcttgagtcgacacgagcagtacttcgggccgggcaccaggctcacggtcacaggtgagattcgggcgtctccccaccttccagcccctcggtccccggagtcggagggtggacgaagataggcttgactgatggcgcgagggaggc

SEQ ID NO: 3651 - DNA, 495 bp, Artificial Sequence
  Oligonucleotide
gccttgccagcccgctcagactgtggagacactctcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagacactctgtcgacactgaagctttctttggacaaggcaccagactcacagttgtaggtaagacatttttcaggttcttttgcagatccgtcacagggaaaagtgggtccacagactgtggagacactctctgatggcgcgagggaggc

SEQ ID NO: 3652 - DNA, 495 bp, Artificial Sequence
  Oligonucleotide
gccttgccagcccgctcagactgtggattcggaaccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggattcggaacgtcgactatggctacaccttcggttcggggaccaggttaaccgttgtaggtaaggctgggggtctctaggaggggtgcgatgagggaggactctgtcctgggaaatactgtggattcggaacctgatggcgcgagggaggc

SEQ ID NO: 3653 - DNA, 495 bp, Artificial Sequence
  Oligonucleotide
gccttgccagcccgctcagactgtggaaagtaacgcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaaagtaacggtcgacgaaacaccatatattttggagagggaagttggctcactgttgtaggtgagtaagtcaaggctggacagctgggaacttgcaaaaaggggctggaatccagactgtggaaagtaacgctgatggcgcgagggaggc

SEQ ID NO: 3654 - DNA, 495 bp, Artificial Sequence
  Oligonucleotide
gccttgccagcccgctcagactgtggagtctcctacccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagtctcctagtcgacaatgaaaaactgttttttggcagtggaacccagctctctgtcttgggtatgtaaaagacttctttcgggatagtgtatcataaggtcggagttccaggagactgtggagtctcctactgatggcgcgagggaggc

SEQ ID NO: 3655 - DNA, 495 bp, Artificial Sequence
  Oligonucleotide
gccttgccagcccgctcagactgtggaagagtgtccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaagagtgtcgtcgacatcagccccagcattttggtgatgggactcgactctccatcctaggtaagttgcagaatcagggtggtatggccattgtcccttgaaggcagagttctctactgtggaagagtgtcctgatggcgcgagggaggc

SEQ ID NO: 3656 - DNA, 495 bp, Artificial Sequence
  Oligonucleotide
gccttgccagcccgctcagactgtggagttccgaacccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagttccgaagtcgacataattcacccctccactttgggaacgggaccaggctcactgtgacaggtatgggggctccactcttgactcgggggtgcctgggtttgactgcaatgatactgtggagttccgaactgatggcgcgagggaggc

SEQ ID NO: 3657 - DNA, 495 bp, Artificial Sequence
  Oligonucleotide
gccttgccagcccgctcagactgtggacgttacttcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggacgttacttgtcgacacaatgagcagttcttcgggccagggacacggctcaccgtgctaggtaagaagggggctccaggtgggagagagggtgagcagcccagcctgcacgacccactgtggacgttacttctgatggcgcgagggaggc

SEQ ID NO: 3658 - DNA, 495 bp, Artificial Sequence
  Oligonucleotide
gccttgccagcccgctcagactgtggataggagaccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggataggagacgtcgacaccggggagctgttttttggagaaggctctaggctgaccgtactgggtaaggaggcggttggggctccggagagctccgagagggcgggatgggcagaggactgtggataggagacctgatggcgcgagggaggc

SEQ ID NO: 3659 - DNA, 495 bp, Artificial Sequence
  Oligonucleotide
gccttgccagcccgctcagactgtggagtgtctaccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagtgtctacgtcgacagatacgcagtattttggcccaggcacccggctgacagtgctcggtaagcgggggctcccgctgaagccccggaactggggagggggcgccccgggacgcactgtggagtgtctacctgatggcgcgagggaggc

SEQ ID NO: 3660 - DNA, 495 bp, Artificial Sequence
  Oligonucleotide
gccttgccagcccgctcagactgtggagtacagtgcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggagtacagtggtcgacaaaacattcagtacttcggcgccgggacccggctctcagtgctgggtaagctggggccgccgggggaccggggacgagactgcgctcgggtttttgtgcgactgtggagtacagtgctgatggcgcgagggaggc

SEQ ID NO: 3661 - DNA, 495 bp, Artificial Sequence
  Oligonucleotide
gccttgccagcccgctcagactgtggaggatcatccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaggatcatcgtcgacgagacccagtacttcgggccaggcacgcggctcctggtgctcggtgagcgcgggctgctggggcgcgggcgcgggcggcttgggtctggtttttgcggggactgtggaggatcatcctgatggcgcgagggaggc

SEQ ID NO: 3662 - DNA, 495 bp, Artificial Sequence
  Oligonucleotide
gccttgccagcccgctcagactgtggatattggcgcccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggatattggcggtcgacgggccaacgtcctgactttcggggccggcagcaggctgaccgtgctgggtgagttttcgcgggaccacccgggcggcgggattcaggtggaaggcggcggactgtggatattggcgctgatggcgcgagggaggc

SEQ ID NO: 3663 - DNA, 495 bp, Artificial Sequence
  Oligonucleotide
gccttgccagcccgctcagactgtggaaggcttgacccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagtgaactgtggaaggcttgagtcgacacgagcagtacttcgggccgggcaccaggctcacggtcacaggtgagattcgggcgtctccccaccttccagcccctcggtccccggagtcggagggtggactgtggaaggcttgactgatggcgcgagggaggc

SEQ ID NO: 3664 - DNA, 495 bp, Artificial Sequence
  Oligonucleotide
gccttgccagcccgctcagggtgtcatgacactctcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgacactctgtcgacactgaagctttctttggacaaggcaccagactcacagttgtaggtaagacatttttcaggttcttttgcagatccgtcacagggaaaagtgggtccacagggtgtcatgacactctctgatggcgcgagggaggc

SEQ ID NO: 3665 - DNA, 495 bp, Artificial Sequence
  Oligonucleotide
gccttgccagcccgctcagggtgtcatttcggaaccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatttcggaacgtcgactatggctacaccttcggttcggggaccaggttaaccgttgtaggtaaggctgggggtctctaggaggggtgcgatgagggaggactctgtcctgggaaatggtgtcatttcggaacctgatggcgcgagggaggc

SEQ ID NO: 3666 - DNA, 495 bp, Artificial Sequence
  Oligonucleotide
gccttgccagcccgctcagggtgtcataagtaacgcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcataagtaacggtcgacgaaacaccatatattttggagagggaagttggctcactgttgtaggtgagtaagtcaaggctggacagctgggaacttgcaaaaaggggctggaatccagggtgtcataagtaacgctgatggcgcgagggaggc

SEQ ID NO: 3667 - DNA, 495 bp, Artificial Sequence
  Oligonucleotide
gccttgccagcccgctcagggtgtcatgtctcctacttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgtctcctagtcgacaatgaaaaactgttttttggcagtggaacccagctctctgtcttgggtatgtaaaagacttctttcgggatagtgtatcataaggtcggagttccaggagggtgtcatgtctcctactgatggcgcgagggaggc

SEQ ID NO: 3668 - DNA, 495 bp, Artificial Sequence
  Oligonucleotide
gccttgccagcccgctcagggtgtcatagagtgtccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatagagtgtcgtcgacatcagccccagcattttggtgatgggactcgactctccatcctaggtaagttgcagaatcagggtggtatggccattgtcccttgaaggcagagttctctggtgtcatagagtgtcctgatggcgcgagggaggc

SEQ ID NO: 3669 - DNA, 495 bp, Artificial Sequence
  Oligonucleotide
gccttgccagcccgctcagggtgtcatgttccgaacttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgttccgaagtcgacataattcacccctccactttgggaacgggaccaggctcactgtgacaggtatgggggctccactcttgactcgggggtgcctgggtttgactgcaatgatggtgtcatgttccgaactgatggcgcgagggaggc

SEQ ID NO: 3670 - DNA, 495 bp, Artificial Sequence
  Oligonucleotide
gccttgccagcccgctcagggtgtcatcgttacttcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatcgttacttgtcgacacaatgagcagttcttcgggccagggacacggctcaccgtgctaggtaagaagggggctccaggtgggagagagggtgagcagcccagcctgcacgacccggtgtcatcgttacttctgatggcgcgagggaggc

SEQ ID NO: 3671 - DNA, 495 bp, Artificial Sequence
  Oligonucleotide
gccttgccagcccgctcagggtgtcattaggagaccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcattaggagacgtcgacaccggggagctgttttttggagaaggctctaggctgaccgtactgggtaaggaggcggttggggctccggagagctccgagagggcgggatgggcagaggggtgtcattaggagacctgatggcgcgagggaggc

SEQ ID NO: 3672 - DNA, 495 bp, Artificial Sequence
  Oligonucleotide
gccttgccagcccgctcagggtgtcatgtgtctaccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgtgtctacgtcgacagatacgcagtattttggcccaggcacccggctgacagtgctcggtaagcgggggctcccgctgaagccccggaactggggagggggcgccccgggacgcggtgtcatgtgtctacctgatggcgcgagggaggc

SEQ ID NO: 3673 - DNA, 495 bp, Artificial Sequence
  Oligonucleotide
gccttgccagcccgctcagggtgtcatgtacagtgcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatgtacagtggtcgacaaaacattcagtacttcggcgccgggacccggctctcagtgctgggtaagctggggccgccgggggaccggggacgagactgcgctcgggtttttgtgcgggtgtcatgtacagtgctgatggcgcgagggaggc

SEQ ID NO: 3674 - DNA, 495 bp, Artificial Sequence
  Oligonucleotide
gccttgccagcccgctcagggtgtcatggatcatccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcatggatcatcgtcgacgagacccagtacttcgggccaggcacgcggctcctggtgctcggtgagcgcgggctgctggggcgcgggcgcgggcggcttgggtctggtttttgcggggggtgtcatggatcatcctgatggcgcgagggaggc

SEQ ID NO: 3675 - DNA, 495 bp, Artificial Sequence
  Oligonucleotide
gccttgccagcccgctcagggtgtcattattggcgcttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcattattggcggtcgacgggccaacgtcctgactttcggggccggcagcaggctgaccgtgctgggtgagttttcgcgggaccacccgggcggcgggattcaggtggaaggcggcggggtgtcattattggcgctgatggcgcgagggaggc

SEQ ID NO: 3676 - DNA, 495 bp, Artificial Sequence
  Oligonucleotide
gccttgccagcccgctcagggtgtcataggcttgacttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagtgaggtgtcataggcttgagtcgacacgagcagtacttcgggccgggcaccaggctcacggtcacaggtgagattcgggcgtctccccaccttccagcccctcggtccccggagtcggagggtggggtgtcataggcttgactgatggcgcgagggaggc

SEQ ID NO: 3677 - DNA, 495 bp, Artificial Sequence
  Oligonucleotide
gccttgccagcccgctcagtcgtgaaggacactctccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggacactctgtcgacactgaagctttctttggacaaggcaccagactcacagttgtaggtaagacatttttcaggttcttttgcagatccgtcacagggaaaagtgggtccacagtcgtgaaggacactctctgatggcgcgagggaggc

SEQ ID NO: 3678 - DNA, 495 bp, Artificial Sequence
  Oligonucleotide
gccttgccagcccgctcagtcgtgaagttcggaacccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagttcggaacgtcgactatggctacaccttcggttcggggaccaggttaaccgttgtaggtaaggctgggggtctctaggaggggtgcgatgagggaggactctgtcctgggaaattcgtgaagttcggaacctgatggcgcgagggaggc

SEQ ID NO: 3679 - DNA, 495 bp, Artificial Sequence
  Oligonucleotide
gccttgccagcccgctcagtcgtgaagaagtaacgccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagaagtaacggtcgacgaaacaccatatattttggagagggaagttggctcactgttgtaggtgagtaagtcaaggctggacagctgggaacttgcaaaaaggggctggaatccagtcgtgaagaagtaacgctgatggcgcgagggaggc

SEQ ID NO: 3680 - DNA, 495 bp, Artificial Sequence
  Oligonucleotide
gccttgccagcccgctcagtcgtgaaggtctcctaccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggtctcctagtcgacaatgaaaaactgttttttggcagtggaacccagctctctgtcttgggtatgtaaaagacttctttcgggatagtgtatcataaggtcggagttccaggagtcgtgaaggtctcctactgatggcgcgagggaggc

SEQ ID NO: 3681 - DNA, 495 bp, Artificial Sequence
  Oligonucleotide
gccttgccagcccgctcagtcgtgaagagagtgtcccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagagagtgtcgtcgacatcagccccagcattttggtgatgggactcgactctccatcctaggtaagttgcagaatcagggtggtatggccattgtcccttgaaggcagagttctcttcgtgaagagagtgtcctgatggcgcgagggaggc

SEQ ID NO: 3682 - DNA, 495 bp, Artificial Sequence
  Oligonucleotide
gccttgccagcccgctcagtcgtgaaggttccgaaccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggttccgaagtcgacataattcacccctccactttgggaacgggaccaggctcactgtgacaggtatgggggctccactcttgactcgggggtgcctgggtttgactgcaatgattcgtgaaggttccgaactgatggcgcgagggaggc

SEQ ID NO: 3683 - DNA, 495 bp, Artificial Sequence
  Oligonucleotide
gccttgccagcccgctcagtcgtgaagcgttacttccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagcgttacttgtcgacacaatgagcagttcttcgggccagggacacggctcaccgtgctaggtaagaagggggctccaggtgggagagagggtgagcagcccagcctgcacgaccctcgtgaagcgttacttctgatggcgcgagggaggc

SEQ ID NO: 3684 - DNA, 495 bp, Artificial Sequence
  Oligonucleotide
gccttgccagcccgctcagtcgtgaagtaggagacccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagtaggagacgtcgacaccggggagctgttttttggagaaggctctaggctgaccgtactgggtaaggaggcggttggggctccggagagctccgagagggcgggatgggcagaggtcgtgaagtaggagacctgatggcgcgagggaggc

SEQ ID NO: 3685 - DNA, 495 bp, Artificial Sequence
  Oligonucleotide
gccttgccagcccgctcagtcgtgaaggtgtctacccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggtgtctacgtcgacagatacgcagtattttggcccaggcacccggctgacagtgctcggtaagcgggggctcccgctgaagccccggaactggggagggggcgccccgggacgctcgtgaaggtgtctacctgatggcgcgagggaggc

SEQ ID NO: 3686 - DNA, 495 bp, Artificial Sequence
  Oligonucleotide
gccttgccagcccgctcagtcgtgaaggtacagtgccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaaggtacagtggtcgacaaaacattcagtacttcggcgccgggacccggctctcagtgctgggtaagctggggccgccgggggaccggggacgagactgcgctcgggtttttgtgcgtcgtgaaggtacagtgctgatggcgcgagggaggc

SEQ ID NO: 3687 - DNA, 495 bp, Artificial Sequence
  Oligonucleotide
gccttgccagcccgctcagtcgtgaagggatcatcccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagggatcatcgtcgacgagacccagtacttcgggccaggcacgcggctcctggtgctcggtgagcgcgggctgctggggcgcgggcgcgggcggcttgggtctggtttttgcggggtcgtgaagggatcatcctgatggcgcgagggaggc

SEQ ID NO: 3688 - DNA, 495 bp, Artificial Sequence
  Oligonucleotide
gccttgccagcccgctcagtcgtgaagtattggcgccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagtattggcggtcgacgggccaacgtcctgactttcggggccggcagcaggctgaccgtgctgggtgagttttcgcgggaccacccgggcggcgggattcaggtggaaggcggcggtcgtgaagtattggcgctgatggcgcgagggaggc

SEQ ID NO: 3689 - DNA, 495 bp, Artificial Sequence
  Oligonucleotide
gccttgccagcccgctcagtcgtgaagaggcttgaccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagtgatcgtgaagaggcttgagtcgacacgagcagtacttcgggccgggcaccaggctcacggtcacaggtgagattcgggcgtctccccaccttccagcccctcggtccccggagtcggagggtggtcgtgaagaggcttgactgatggcgcgagggaggc

SEQ ID NO: 3690 - DNA, 495 bp, Artificial Sequence
  Oligonucleotide
gccttgccagcccgctcagcactagctgacactctttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgacactctgtcgacactgaagctttctttggacaaggcaccagactcacagttgtaggtaagacatttttcaggttcttttgcagatccgtcacagggaaaagtgggtccacagcactagctgacactctctgatggcgcgagggaggc

SEQ ID NO: 3691 - DNA, 495 bp, Artificial Sequence
  Oligonucleotide
gccttgccagcccgctcagcactagctttcggaacttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctttcggaacgtcgactatggctacaccttcggttcggggaccaggttaaccgttgtaggtaaggctgggggtctctaggaggggtgcgatgagggaggactctgtcctgggaaatcactagctttcggaacctgatggcgcgagggaggc

SEQ ID NO: 3692 - DNA, 495 bp, Artificial Sequence
  Oligonucleotide
gccttgccagcccgctcagcactagctaagtaacgttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctaagtaacggtcgacgaaacaccatatattttggagagggaagttggctcactgttgtaggtgagtaagtcaaggctggacagctgggaacttgcaaaaaggggctggaatccagcactagctaagtaacgctgatggcgcgagggaggc

SEQ ID NO: 3693 - DNA, 495 bp, Artificial Sequence
  Oligonucleotide
gccttgccagcccgctcagcactagctgtctcctattttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgtctcctagtcgacaatgaaaaactgttttttggcagtggaacccagctctctgtcttgggtatgtaaaagacttctttcgggatagtgtatcataaggtcggagttccaggagcactagctgtctcctactgatggcgcgagggaggc

SEQ ID NO: 3694 - DNA, 495 bp, Artificial Sequence
  Oligonucleotide
gccttgccagcccgctcagcactagctagagtgtcttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctagagtgtcgtcgacatcagccccagcattttggtgatgggactcgactctccatcctaggtaagttgcagaatcagggtggtatggccattgtcccttgaaggcagagttctctcactagctagagtgtcctgatggcgcgagggaggc

SEQ ID NO: 3695 - DNA, 495 bp, Artificial Sequence
  Oligonucleotide
gccttgccagcccgctcagcactagctgttccgaattttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgttccgaagtcgacataattcacccctccactttgggaacgggaccaggctcactgtgacaggtatgggggctccactcttgactcgggggtgcctgggtttgactgcaatgatcactagctgttccgaactgatggcgcgagggaggc

SEQ ID NO: 3696 - DNA, 495 bp, Artificial Sequence
  Oligonucleotide
gccttgccagcccgctcagcactagctcgttacttttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctcgttacttgtcgacacaatgagcagttcttcgggccagggacacggctcaccgtgctaggtaagaagggggctccaggtgggagagagggtgagcagcccagcctgcacgaccccactagctcgttacttctgatggcgcgagggaggc

SEQ ID NO: 3697 - DNA, 495 bp, Artificial Sequence
  Oligonucleotide
gccttgccagcccgctcagcactagcttaggagacttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagcttaggagacgtcgacaccggggagctgttttttggagaaggctctaggctgaccgtactgggtaaggaggcggttggggctccggagagctccgagagggcgggatgggcagaggcactagcttaggagacctgatggcgcgagggaggc

SEQ ID NO: 3698 - DNA, 495 bp, Artificial Sequence
  Oligonucleotide
gccttgccagcccgctcagcactagctgtgtctacttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgtgtctacgtcgacagatacgcagtattttggcccaggcacccggctgacagtgctcggtaagcgggggctcccgctgaagccccggaactggggagggggcgccccgggacgccactagctgtgtctacctgatggcgcgagggaggc

SEQ ID NO: 3699 - DNA, 495 bp, Artificial Sequence
  Oligonucleotide
gccttgccagcccgctcagcactagctgtacagtgttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctgtacagtggtcgacaaaacattcagtacttcggcgccgggacccggctctcagtgctgggtaagctggggccgccgggggaccggggacgagactgcgctcgggtttttgtgcgcactagctgtacagtgctgatggcgcgagggaggc

SEQ ID NO: 3700 - DNA, 495 bp, Artificial Sequence
  Oligonucleotide
gccttgccagcccgctcagcactagctggatcatcttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctggatcatcgtcgacgagacccagtacttcgggccaggcacgcggctcctggtgctcggtgagcgcgggctgctggggcgcgggcgcgggcggcttgggtctggtttttgcggggcactagctggatcatcctgatggcgcgagggaggc

SEQ ID NO: 3701 - DNA, 495 bp, Artificial Sequence
  Oligonucleotide
gccttgccagcccgctcagcactagcttattggcgttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagcttattggcggtcgacgggccaacgtcctgactttcggggccggcagcaggctgaccgtgctgggtgagttttcgcgggaccacccgggcggcgggattcaggtggaaggcggcggcactagcttattggcgctgatggcgcgagggaggc

SEQ ID NO: 3702 - DNA, 495 bp, Artificial Sequence
  Oligonucleotide
gccttgccagcccgctcagcactagctaggcttgattttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagtgacactagctaggcttgagtcgacacgagcagtacttcgggccgggcaccaggctcacggtcacaggtgagattcgggcgtctccccaccttccagcccctcggtccccggagtcggagggtggcactagctaggcttgactgatggcgcgagggaggc

SEQ ID NO: 3703 - DNA, 495 bp, Artificial Sequence
  Oligonucleotide
gccttgccagcccgctcagcttggttagacactctttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagacactctgtcgacactgaagctttctttggacaaggcaccagactcacagttgtaggtaagacatttttcaggttcttttgcagatccgtcacagggaaaagtgggtccacagcttggttagacactctctgatggcgcgagggaggc

SEQ ID NO: 3704 - DNA, 495 bp, Artificial Sequence
  Oligonucleotide
gccttgccagcccgctcagcttggttattcggaacttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttattcggaacgtcgactatggctacaccttcggttcggggaccaggttaaccgttgtaggtaaggctgggggtctctaggaggggtgcgatgagggaggactctgtcctgggaaatcttggttattcggaacctgatggcgcgagggaggc

SEQ ID NO: 3705 - DNA, 495 bp, Artificial Sequence
  Oligonucleotide
gccttgccagcccgctcagcttggttaaagtaacgttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaaagtaacggtcgacgaaacaccatatattttggagagggaagttggctcactgttgtaggtgagtaagtcaaggctggacagctgggaacttgcaaaaaggggctggaatccagcttggttaaagtaacgctgatggcgcgagggaggc

SEQ ID NO: 3706 - DNA, 495 bp, Artificial Sequence
  Oligonucleotide
gccttgccagcccgctcagcttggttagtctcctattttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagtctcctagtcgacaatgaaaaactgttttttggcagtggaacccagctctctgtcttgggtatgtaaaagacttctttcgggatagtgtatcataaggtcggagttccaggagcttggttagtctcctactgatggcgcgagggaggc

SEQ ID NO: 3707 - DNA, 495 bp, Artificial Sequence
  Oligonucleotide
gccttgccagcccgctcagcttggttaagagtgtcttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaagagtgtcgtcgacatcagccccagcattttggtgatgggactcgactctccatcctaggtaagttgcagaatcagggtggtatggccattgtcccttgaaggcagagttctctcttggttaagagtgtcctgatggcgcgagggaggc

SEQ ID NO: 3708 - DNA, 495 bp, Artificial Sequence
  Oligonucleotide
gccttgccagcccgctcagcttggttagttccgaattttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagttccgaagtcgacataattcacccctccactttgggaacgggaccaggctcactgtgacaggtatgggggctccactcttgactcgggggtgcctgggtttgactgcaatgatcttggttagttccgaactgatggcgcgagggaggc

SEQ ID NO: 3709 - DNA, 495 bp, Artificial Sequence
  Oligonucleotide
gccttgccagcccgctcagcttggttacgttacttttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttacgttacttgtcgacacaatgagcagttcttcgggccagggacacggctcaccgtgctaggtaagaagggggctccaggtgggagagagggtgagcagcccagcctgcacgaccccttggttacgttacttctgatggcgcgagggaggc

SEQ ID NO: 3710 - DNA, 495 bp, Artificial Sequence
  Oligonucleotide
gccttgccagcccgctcagcttggttataggagacttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttataggagacgtcgacaccggggagctgttttttggagaaggctctaggctgaccgtactgggtaaggaggcggttggggctccggagagctccgagagggcgggatgggcagaggcttggttataggagacctgatggcgcgagggaggc

SEQ ID NO: 3711 - DNA, 495 bp, Artificial Sequence
  Oligonucleotide
gccttgccagcccgctcagcttggttagtgtctacttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagtgtctacgtcgacagatacgcagtattttggcccaggcacccggctgacagtgctcggtaagcgggggctcccgctgaagccccggaactggggagggggcgccccgggacgccttggttagtgtctacctgatggcgcgagggaggc

SEQ ID NO: 3712 - DNA, 495 bp, Artificial Sequence
  Oligonucleotide
gccttgccagcccgctcagcttggttagtacagtgttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttagtacagtggtcgacaaaacattcagtacttcggcgccgggacccggctctcagtgctgggtaagctggggccgccgggggaccggggacgagactgcgctcgggtttttgtgcgcttggttagtacagtgctgatggcgcgagggaggc

SEQ ID NO: 3713 - DNA, 495 bp, Artificial Sequence
  Oligonucleotide
gccttgccagcccgctcagcttggttaggatcatcttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaggatcatcgtcgacgagacccagtacttcgggccaggcacgcggctcctggtgctcggtgagcgcgggctgctggggcgcgggcgcgggcggcttgggtctggtttttgcggggcttggttaggatcatcctgatggcgcgagggaggc

SEQ ID NO: 3714 - DNA, 495 bp, Artificial Sequence
  Oligonucleotide
gccttgccagcccgctcagcttggttatattggcgttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttatattggcggtcgacgggccaacgtcctgactttcggggccggcagcaggctgaccgtgctgggtgagttttcgcgggaccacccgggcggcgggattcaggtggaaggcggcggcttggttatattggcgctgatggcgcgagggaggc

SEQ ID NO: 3715 - DNA, 495 bp, Artificial Sequence
  Oligonucleotide
gccttgccagcccgctcagcttggttaaggcttgattttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgtgacttggttaaggcttgagtcgacacgagcagtacttcgggccgggcaccaggctcacggtcacaggtgagattcgggcgtctccccaccttccagcccctcggtccccggagtcggagggtggcttggttaaggcttgactgatggcgcgagggaggc

SEQ ID NO: 3716 - DNA, 495 bp, Artificial Sequence
  Oligonucleotide
gccttgccagcccgctcagacctcttggacactcttttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggacactctgtcgacactgaagctttctttggacaaggcaccagactcacagttgtaggtaagacatttttcaggttcttttgcagatccgtcacagggaaaagtgggtccacagacctcttggacactctctgatggcgcgagggaggc

SEQ ID NO: 3717 - DNA, 495 bp, Artificial Sequence
  Oligonucleotide
gccttgccagcccgctcagacctcttgttcggaactttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgttcggaacgtcgactatggctacaccttcggttcggggaccaggttaaccgttgtaggtaaggctgggggtctctaggaggggtgcgatgagggaggactctgtcctgggaaatacctcttgttcggaacctgatggcgcgagggaggc

SEQ ID NO: 3718 - DNA, 495 bp, Artificial Sequence
  Oligonucleotide
gccttgccagcccgctcagacctcttgaagtaacgtttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgaagtaacggtcgacgaaacaccatatattttggagagggaagttggctcactgttgtaggtgagtaagtcaaggctggacagctgggaacttgcaaaaaggggctggaatccagacctcttgaagtaacgctgatggcgcgagggaggc

SEQ ID NO: 3719 - DNA, 495 bp, Artificial Sequence
  Oligonucleotide
gccttgccagcccgctcagacctcttggtctcctatttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggtctcctagtcgacaatgaaaaactgttttttggcagtggaacccagctctctgtcttgggtatgtaaaagacttctttcgggatagtgtatcataaggtcggagttccaggagacctcttggtctcctactgatggcgcgagggaggc

SEQ ID NO: 3720 - DNA, 495 bp, Artificial Sequence
  Oligonucleotide
gccttgccagcccgctcagacctcttgagagtgtctttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgagagtgtcgtcgacatcagccccagcattttggtgatgggactcgactctccatcctaggtaagttgcagaatcagggtggtatggccattgtcccttgaaggcagagttctctacctcttgagagtgtcctgatggcgcgagggaggc

SEQ ID NO: 3721 - DNA, 495 bp, Artificial Sequence
  Oligonucleotide
gccttgccagcccgctcagacctcttggttccgaatttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggttccgaagtcgacataattcacccctccactttgggaacgggaccaggctcactgtgacaggtatgggggctccactcttgactcgggggtgcctgggtttgactgcaatgatacctcttggttccgaactgatggcgcgagggaggc

SEQ ID NO: 3722 - DNA, 495 bp, Artificial Sequence
  Oligonucleotide
gccttgccagcccgctcagacctcttgcgttactttttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgcgttacttgtcgacacaatgagcagttcttcgggccagggacacggctcaccgtgctaggtaagaagggggctccaggtgggagagagggtgagcagcccagcctgcacgacccacctcttgcgttacttctgatggcgcgagggaggc

SEQ ID NO: 3723 - DNA, 495 bp, Artificial Sequence
  Oligonucleotide
gccttgccagcccgctcagacctcttgtaggagactttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgtaggagacgtcgacaccggggagctgttttttggagaaggctctaggctgaccgtactgggtaaggaggcggttggggctccggagagctccgagagggcgggatgggcagaggacctcttgtaggagacctgatggcgcgagggaggc

SEQ ID NO: 3724 - DNA, 495 bp, Artificial Sequence
  Oligonucleotide
gccttgccagcccgctcagacctcttggtgtctactttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggtgtctacgtcgacagatacgcagtattttggcccaggcacccggctgacagtgctcggtaagcgggggctcccgctgaagccccggaactggggagggggcgccccgggacgcacctcttggtgtctacctgatggcgcgagggaggc

SEQ ID NO: 3725 - DNA, 495 bp, Artificial Sequence
  Oligonucleotide
gccttgccagcccgctcagacctcttggtacagtgtttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttggtacagtggtcgacaaaacattcagtacttcggcgccgggacccggctctcagtgctgggtaagctggggccgccgggggaccggggacgagactgcgctcgggtttttgtgcgacctcttggtacagtgctgatggcgcgagggaggc

SEQ ID NO: 3726 - DNA, 495 bp, Artificial Sequence
  Oligonucleotide
gccttgccagcccgctcagacctcttgggatcatctttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgggatcatcgtcgacgagacccagtacttcgggccaggcacgcggctcctggtgctcggtgagcgcgggctgctggggcgcgggcgcgggcggcttgggtctggtttttgcggggacctcttgggatcatcctgatggcgcgagggaggc

SEQ ID NO: 3727 - DNA, 495 bp, Artificial Sequence
  Oligonucleotide
gccttgccagcccgctcagacctcttgtattggcgtttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgtattggcggtcgacgggccaacgtcctgactttcggggccggcagcaggctgaccgtgctgggtgagttttcgcgggaccacccgggcggcgggattcaggtggaaggcggcggacctcttgtattggcgctgatggcgcgagggaggc

SEQ ID NO: 3728 - DNA, 495 bp, Artificial Sequence
  Oligonucleotide
gccttgccagcccgctcagacctcttgaggcttgatttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgaacctcttgaggcttgagtcgacacgagcagtacttcgggccgggcaccaggctcacggtcacaggtgagattcgggcgtctccccaccttccagcccctcggtccccggagtcggagggtggacctcttgaggcttgactgatggcgcgagggaggc

SEQ ID NO: 3729 - DNA, 495 bp, Artificial Sequence
  Oligonucleotide
gccttgccagcccgctcagctgattctgacactctcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgacactctgtcgacactgaagctttctttggacaaggcaccagactcacagttgtaggtaagacatttttcaggttcttttgcagatccgtcacagggaaaagtgggtccacagctgattctgacactctctgatggcgcgagggaggc

SEQ ID NO: 3730 - DNA, 495 bp, Artificial Sequence
  Oligonucleotide
gccttgccagcccgctcagctgattctttcggaaccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctttcggaacgtcgactatggctacaccttcggttcggggaccaggttaaccgttgtaggtaaggctgggggtctctaggaggggtgcgatgagggaggactctgtcctgggaaatctgattctttcggaacctgatggcgcgagggaggc

SEQ ID NO: 3731 - DNA, 495 bp, Artificial Sequence
  Oligonucleotide
gccttgccagcccgctcagctgattctaagtaacgcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctaagtaacggtcgacgaaacaccatatattttggagagggaagttggctcactgttgtaggtgagtaagtcaaggctggacagctgggaacttgcaaaaaggggctggaatccagctgattctaagtaacgctgatggcgcgagggaggc

SEQ ID NO: 3732 - DNA, 495 bp, Artificial Sequence
  Oligonucleotide
gccttgccagcccgctcagctgattctgtctcctacttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgtctcctagtcgacaatgaaaaactgttttttggcagtggaacccagctctctgtcttgggtatgtaaaagacttctttcgggatagtgtatcataaggtcggagttccaggagctgattctgtctcctactgatggcgcgagggaggc

SEQ ID NO: 3733 - DNA, 495 bp, Artificial Sequence
  Oligonucleotide
gccttgccagcccgctcagctgattctagagtgtccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctagagtgtcgtcgacatcagccccagcattttggtgatgggactcgactctccatcctaggtaagttgcagaatcagggtggtatggccattgtcccttgaaggcagagttctctctgattctagagtgtcctgatggcgcgagggaggc

SEQ ID NO: 3734 - DNA, 495 bp, Artificial Sequence
  Oligonucleotide
gccttgccagcccgctcagctgattctgttccgaacttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgttccgaagtcgacataattcacccctccactttgggaacgggaccaggctcactgtgacaggtatgggggctccactcttgactcgggggtgcctgggtttgactgcaatgatctgattctgttccgaactgatggcgcgagggaggc

SEQ ID NO: 3735 - DNA, 495 bp, Artificial Sequence
  Oligonucleotide
gccttgccagcccgctcagctgattctcgttacttcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctcgttacttgtcgacacaatgagcagttcttcgggccagggacacggctcaccgtgctaggtaagaagggggctccaggtgggagagagggtgagcagcccagcctgcacgacccctgattctcgttacttctgatggcgcgagggaggc

SEQ ID NO: 3736 - DNA, 495 bp, Artificial Sequence
  Oligonucleotide
gccttgccagcccgctcagctgattcttaggagaccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattcttaggagacgtcgacaccggggagctgttttttggagaaggctctaggctgaccgtactgggtaaggaggcggttggggctccggagagctccgagagggcgggatgggcagaggctgattcttaggagacctgatggcgcgagggaggc

SEQ ID NO: 3737 - DNA, 495 bp, Artificial Sequence
  Oligonucleotide
gccttgccagcccgctcagctgattctgtgtctaccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgtgtctacgtcgacagatacgcagtattttggcccaggcacccggctgacagtgctcggtaagcgggggctcccgctgaagccccggaactggggagggggcgccccgggacgcctgattctgtgtctacctgatggcgcgagggaggc

SEQ ID NO: 3738 - DNA, 495 bp, Artificial Sequence
  Oligonucleotide
gccttgccagcccgctcagctgattctgtacagtgcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctgtacagtggtcgacaaaacattcagtacttcggcgccgggacccggctctcagtgctgggtaagctggggccgccgggggaccggggacgagactgcgctcgggtttttgtgcgctgattctgtacagtgctgatggcgcgagggaggc

SEQ ID NO: 3739 - DNA, 495 bp, Artificial Sequence
  Oligonucleotide
gccttgccagcccgctcagctgattctggatcatccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctggatcatcgtcgacgagacccagtacttcgggccaggcacgcggctcctggtgctcggtgagcgcgggctgctggggcgcgggcgcgggcggcttgggtctggtttttgcggggctgattctggatcatcctgatggcgcgagggaggc

SEQ ID NO: 3740 - DNA, 495 bp, Artificial Sequence
  Oligonucleotide
gccttgccagcccgctcagctgattcttattggcgcttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattcttattggcggtcgacgggccaacgtcctgactttcggggccggcagcaggctgaccgtgctgggtgagttttcgcgggaccacccgggcggcgggattcaggtggaaggcggcggctgattcttattggcgctgatggcgcgagggaggc

SEQ ID NO: 3741 - DNA, 495 bp, Artificial Sequence
  Oligonucleotide
gccttgccagcccgctcagctgattctaggcttgacttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtgactgattctaggcttgagtcgacacgagcagtacttcgggccgggcaccaggctcacggtcacaggtgagattcgggcgtctccccaccttccagcccctcggtccccggagtcggagggtggctgattctaggcttgactgatggcgcgagggaggc

SEQ ID NO: 3742 - DNA, 495 bp, Artificial Sequence
  Oligonucleotide
gccttgccagcccgctcagggtcaactgacactcttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgacactctgtcgacactgaagctttctttggacaaggcaccagactcacagttgtaggtaagacatttttcaggttcttttgcagatccgtcacagggaaaagtgggtccacagggtcaactgacactctctgatggcgcgagggaggc

SEQ ID NO: 3743 - DNA, 495 bp, Artificial Sequence
  Oligonucleotide
gccttgccagcccgctcagggtcaactttcggaactttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactttcggaacgtcgactatggctacaccttcggttcggggaccaggttaaccgttgtaggtaaggctgggggtctctaggaggggtgcgatgagggaggactctgtcctgggaaatggtcaactttcggaacctgatggcgcgagggaggc

SEQ ID NO: 3744 - DNA, 495 bp, Artificial Sequence
  Oligonucleotide
gccttgccagcccgctcagggtcaactaagtaacgtttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactaagtaacggtcgacgaaacaccatatattttggagagggaagttggctcactgttgtaggtgagtaagtcaaggctggacagctgggaacttgcaaaaaggggctggaatccagggtcaactaagtaacgctgatggcgcgagggaggc

SEQ ID NO: 3745 - DNA, 495 bp, Artificial Sequence
  Oligonucleotide
gccttgccagcccgctcagggtcaactgtctcctatttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgtctcctagtcgacaatgaaaaactgttttttggcagtggaacccagctctctgtcttgggtatgtaaaagacttctttcgggatagtgtatcataaggtcggagttccaggagggtcaactgtctcctactgatggcgcgagggaggc

SEQ ID NO: 3746 - DNA, 495 bp, Artificial Sequence
  Oligonucleotide
gccttgccagcccgctcagggtcaactagagtgtctttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactagagtgtcgtcgacatcagccccagcattttggtgatgggactcgactctccatcctaggtaagttgcagaatcagggtggtatggccattgtcccttgaaggcagagttctctggtcaactagagtgtcctgatggcgcgagggaggc

SEQ ID NO: 3747 - DNA, 495 bp, Artificial Sequence
  Oligonucleotide
gccttgccagcccgctcagggtcaactgttccgaatttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgttccgaagtcgacataattcacccctccactttgggaacgggaccaggctcactgtgacaggtatgggggctccactcttgactcgggggtgcctgggtttgactgcaatgatggtcaactgttccgaactgatggcgcgagggaggc

SEQ ID NO: 3748 - DNA, 495 bp, Artificial Sequence
  Oligonucleotide
gccttgccagcccgctcagggtcaactcgttactttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactcgttacttgtcgacacaatgagcagttcttcgggccagggacacggctcaccgtgctaggtaagaagggggctccaggtgggagagagggtgagcagcccagcctgcacgacccggtcaactcgttacttctgatggcgcgagggaggc

SEQ ID NO: 3749 - DNA, 495 bp, Artificial Sequence
  Oligonucleotide
gccttgccagcccgctcagggtcaacttaggagactttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaacttaggagacgtcgacaccggggagctgttttttggagaaggctctaggctgaccgtactgggtaaggaggcggttggggctccggagagctccgagagggcgggatgggcagaggggtcaacttaggagacctgatggcgcgagggaggc

SEQ ID NO: 3750 - DNA, 495 bp, Artificial Sequence
  Oligonucleotide
gccttgccagcccgctcagggtcaactgtgtctactttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgtgtctacgtcgacagatacgcagtattttggcccaggcacccggctgacagtgctcggtaagcgggggctcccgctgaagccccggaactggggagggggcgccccgggacgcggtcaactgtgtctacctgatggcgcgagggaggc

SEQ ID NO: 3751 - DNA, 495 bp, Artificial Sequence
  Oligonucleotide
gccttgccagcccgctcagggtcaactgtacagtgtttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactgtacagtggtcgacaaaacattcagtacttcggcgccgggacccggctctcagtgctgggtaagctggggccgccgggggaccggggacgagactgcgctcgggtttttgtgcgggtcaactgtacagtgctgatggcgcgagggaggc

SEQ ID NO: 3752 - DNA, 495 bp, Artificial Sequence
  Oligonucleotide
gccttgccagcccgctcagggtcaactggatcatctttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactggatcatcgtcgacgagacccagtacttcgggccaggcacgcggctcctggtgctcggtgagcgcgggctgctggggcgcgggcgcgggcggcttgggtctggtttttgcggggggtcaactggatcatcctgatggcgcgagggaggc

SEQ ID NO: 3753 - DNA, 495 bp, Artificial Sequence
  Oligonucleotide
gccttgccagcccgctcagggtcaacttattggcgtttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaacttattggcggtcgacgggccaacgtcctgactttcggggccggcagcaggctgaccgtgctgggtgagttttcgcgggaccacccgggcggcgggattcaggtggaaggcggcggggtcaacttattggcgctgatggcgcgagggaggc

SEQ ID NO: 3754 - DNA, 495 bp, Artificial Sequence
  Oligonucleotide
gccttgccagcccgctcagggtcaactaggcttgatttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtgaggtcaactaggcttgagtcgacacgagcagtacttcgggccgggcaccaggctcacggtcacaggtgagattcgggcgtctccccaccttccagcccctcggtccccggagtcggagggtggggtcaactaggcttgactgatggcgcgagggaggc

SEQ ID NO: 3755 - DNA, 495 bp, Artificial Sequence
  Oligonucleotide
gccttgccagcccgctcaggcataactgacactctttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgacactctgtcgacactgaagctttctttggacaaggcaccagactcacagttgtaggtaagacatttttcaggttcttttgcagatccgtcacagggaaaagtgggtccacaggcataactgacactctctgatggcgcgagggaggc

SEQ ID NO: 3756 - DNA, 495 bp, Artificial Sequence
  Oligonucleotide
gccttgccagcccgctcaggcataactttcggaacttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactttcggaacgtcgactatggctacaccttcggttcggggaccaggttaaccgttgtaggtaaggctgggggtctctaggaggggtgcgatgagggaggactctgtcctgggaaatgcataactttcggaacctgatggcgcgagggaggc

SEQ ID NO: 3757 - DNA, 495 bp, Artificial Sequence
  Oligonucleotide
gccttgccagcccgctcaggcataactaagtaacgttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactaagtaacggtcgacgaaacaccatatattttggagagggaagttggctcactgttgtaggtgagtaagtcaaggctggacagctgggaacttgcaaaaaggggctggaatccaggcataactaagtaacgctgatggcgcgagggaggc

SEQ ID NO: 3758 - DNA, 495 bp, Artificial Sequence
  Oligonucleotide
gccttgccagcccgctcaggcataactgtctcctattcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgtctcctagtcgacaatgaaaaactgttttttggcagtggaacccagctctctgtcttgggtatgtaaaagacttctttcgggatagtgtatcataaggtcggagttccaggaggcataactgtctcctactgatggcgcgagggaggc

SEQ ID NO: 3759 - DNA, 495 bp, Artificial Sequence
  Oligonucleotide
gccttgccagcccgctcaggcataactagagtgtcttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactagagtgtcgtcgacatcagccccagcattttggtgatgggactcgactctccatcctaggtaagttgcagaatcagggtggtatggccattgtcccttgaaggcagagttctctgcataactagagtgtcctgatggcgcgagggaggc

SEQ ID NO: 3760 - DNA, 495 bp, Artificial Sequence
  Oligonucleotide
gccttgccagcccgctcaggcataactgttccgaattcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgttccgaagtcgacataattcacccctccactttgggaacgggaccaggctcactgtgacaggtatgggggctccactcttgactcgggggtgcctgggtttgactgcaatgatgcataactgttccgaactgatggcgcgagggaggc

SEQ ID NO: 3761 - DNA, 495 bp, Artificial Sequence
  Oligonucleotide
gccttgccagcccgctcaggcataactcgttacttttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactcgttacttgtcgacacaatgagcagttcttcgggccagggacacggctcaccgtgctaggtaagaagggggctccaggtgggagagagggtgagcagcccagcctgcacgacccgcataactcgttacttctgatggcgcgagggaggc

SEQ ID NO: 3762 - DNA, 495 bp, Artificial Sequence
  Oligonucleotide
gccttgccagcccgctcaggcataacttaggagacttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataacttaggagacgtcgacaccggggagctgttttttggagaaggctctaggctgaccgtactgggtaaggaggcggttggggctccggagagctccgagagggcgggatgggcagagggcataacttaggagacctgatggcgcgagggaggc

SEQ ID NO: 3763 - DNA, 495 bp, Artificial Sequence
  Oligonucleotide
gccttgccagcccgctcaggcataactgtgtctacttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgtgtctacgtcgacagatacgcagtattttggcccaggcacccggctgacagtgctcggtaagcgggggctcccgctgaagccccggaactggggagggggcgccccgggacgcgcataactgtgtctacctgatggcgcgagggaggc

SEQ ID NO: 3764 - DNA, 495 bp, Artificial Sequence
  Oligonucleotide
gccttgccagcccgctcaggcataactgtacagtgttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactgtacagtggtcgacaaaacattcagtacttcggcgccgggacccggctctcagtgctgggtaagctggggccgccgggggaccggggacgagactgcgctcgggtttttgtgcggcataactgtacagtgctgatggcgcgagggaggc

SEQ ID NO: 3765 - DNA, 495 bp, Artificial Sequence
  Oligonucleotide
gccttgccagcccgctcaggcataactggatcatcttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactggatcatcgtcgacgagacccagtacttcgggccaggcacgcggctcctggtgctcggtgagcgcgggctgctggggcgcgggcgcgggcggcttgggtctggtttttgcgggggcataactggatcatcctgatggcgcgagggaggc

SEQ ID NO: 3766 - DNA, 495 bp, Artificial Sequence
  Oligonucleotide
gccttgccagcccgctcaggcataacttattggcgttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataacttattggcggtcgacgggccaacgtcctgactttcggggccggcagcaggctgaccgtgctgggtgagttttcgcgggaccacccgggcggcgggattcaggtggaaggcggcgggcataacttattggcgctgatggcgcgagggaggc

SEQ ID NO: 3767 - DNA, 495 bp, Artificial Sequence
  Oligonucleotide
gccttgccagcccgctcaggcataactaggcttgattcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagtgagcataactaggcttgagtcgacacgagcagtacttcgggccgggcaccaggctcacggtcacaggtgagattcgggcgtctccccaccttccagcccctcggtccccggagtcggagggtgggcataactaggcttgactgatggcgcgagggaggc

SEQ ID NO: 3768 - DNA, 495 bp, Artificial Sequence
  Oligonucleotide
gccttgccagcccgctcagatatgctggacactcttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggacactctgtcgacactgaagctttctttggacaaggcaccagactcacagttgtaggtaagacatttttcaggttcttttgcagatccgtcacagggaaaagtgggtccacagatatgctggacactctctgatggcgcgagggaggc

SEQ ID NO: 3769 - DNA, 495 bp, Artificial Sequence
  Oligonucleotide
gccttgccagcccgctcagatatgctgttcggaactcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgttcggaacgtcgactatggctacaccttcggttcggggaccaggttaaccgttgtaggtaaggctgggggtctctaggaggggtgcgatgagggaggactctgtcctgggaaatatatgctgttcggaacctgatggcgcgagggaggc

SEQ ID NO: 3770 - DNA, 495 bp, Artificial Sequence
  Oligonucleotide
gccttgccagcccgctcagatatgctgaagtaacgtcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgaagtaacggtcgacgaaacaccatatattttggagagggaagttggctcactgttgtaggtgagtaagtcaaggctggacagctgggaacttgcaaaaaggggctggaatccagatatgctgaagtaacgctgatggcgcgagggaggc

SEQ ID NO: 3771 - DNA, 495 bp, Artificial Sequence
  Oligonucleotide
gccttgccagcccgctcagatatgctggtctcctatcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggtctcctagtcgacaatgaaaaactgttttttggcagtggaacccagctctctgtcttgggtatgtaaaagacttctttcgggatagtgtatcataaggtcggagttccaggagatatgctggtctcctactgatggcgcgagggaggc

SEQ ID NO: 3772 - DNA, 495 bp, Artificial Sequence
  Oligonucleotide
gccttgccagcccgctcagatatgctgagagtgtctcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgagagtgtcgtcgacatcagccccagcattttggtgatgggactcgactctccatcctaggtaagttgcagaatcagggtggtatggccattgtcccttgaaggcagagttctctatatgctgagagtgtcctgatggcgcgagggaggc

SEQ ID NO: 3773 - DNA, 495 bp, Artificial Sequence
  Oligonucleotide
gccttgccagcccgctcagatatgctggttccgaatcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggttccgaagtcgacataattcacccctccactttgggaacgggaccaggctcactgtgacaggtatgggggctccactcttgactcgggggtgcctgggtttgactgcaatgatatatgctggttccgaactgatggcgcgagggaggc

SEQ ID NO: 3774 - DNA, 495 bp, Artificial Sequence
  Oligonucleotide
gccttgccagcccgctcagatatgctgcgttactttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgcgttacttgtcgacacaatgagcagttcttcgggccagggacacggctcaccgtgctaggtaagaagggggctccaggtgggagagagggtgagcagcccagcctgcacgacccatatgctgcgttacttctgatggcgcgagggaggc

SEQ ID NO: 3775 - DNA, 495 bp, Artificial Sequence
  Oligonucleotide
gccttgccagcccgctcagatatgctgtaggagactcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgtaggagacgtcgacaccggggagctgttttttggagaaggctctaggctgaccgtactgggtaaggaggcggttggggctccggagagctccgagagggcgggatgggcagaggatatgctgtaggagacctgatggcgcgagggaggc

SEQ ID NO: 3776 - DNA, 495 bp, Artificial Sequence
  Oligonucleotide
gccttgccagcccgctcagatatgctggtgtctactcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggtgtctacgtcgacagatacgcagtattttggcccaggcacccggctgacagtgctcggtaagcgggggctcccgctgaagccccggaactggggagggggcgccccgggacgcatatgctggtgtctacctgatggcgcgagggaggc

SEQ ID NO: 3777 - DNA, 495 bp, Artificial Sequence
  Oligonucleotide
gccttgccagcccgctcagatatgctggtacagtgtcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctggtacagtggtcgacaaaacattcagtacttcggcgccgggacccggctctcagtgctgggtaagctggggccgccgggggaccggggacgagactgcgctcgggtttttgtgcgatatgctggtacagtgctgatggcgcgagggaggc

SEQ ID NO: 3778 - DNA, 495 bp, Artificial Sequence
  Oligonucleotide
gccttgccagcccgctcagatatgctgggatcatctcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgggatcatcgtcgacgagacccagtacttcgggccaggcacgcggctcctggtgctcggtgagcgcgggctgctggggcgcgggcgcgggcggcttgggtctggtttttgcggggatatgctgggatcatcctgatggcgcgagggaggc

SEQ ID NO: 3779 - DNA, 495 bp, Artificial Sequence
  Oligonucleotide
gccttgccagcccgctcagatatgctgtattggcgtcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgtattggcggtcgacgggccaacgtcctgactttcggggccggcagcaggctgaccgtgctgggtgagttttcgcgggaccacccgggcggcgggattcaggtggaaggcggcggatatgctgtattggcgctgatggcgcgagggaggc

SEQ ID NO: 3780 - DNA, 495 bp, Artificial Sequence
  Oligonucleotide
gccttgccagcccgctcagatatgctgaggcttgatcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagtgaatatgctgaggcttgagtcgacacgagcagtacttcgggccgggcaccaggctcacggtcacaggtgagattcgggcgtctccccaccttccagcccctcggtccccggagtcggagggtggatatgctgaggcttgactgatggcgcgagggaggc

SEQ ID NO: 3781 - DNA, 495 bp, Artificial Sequence
  Oligonucleotide
gccttgccagcccgctcagaatcctgcgacactcttttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgacactctgtcgacactgaagctttctttggacaaggcaccagactcacagttgtaggtaagacatttttcaggttcttttgcagatccgtcacagggaaaagtgggtccacagaatcctgcgacactctctgatggcgcgagggaggc

SEQ ID NO: 3782 - DNA, 495 bp, Artificial Sequence
  Oligonucleotide
gccttgccagcccgctcagaatcctgcttcggaactttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcttcggaacgtcgactatggctacaccttcggttcggggaccaggttaaccgttgtaggtaaggctgggggtctctaggaggggtgcgatgagggaggactctgtcctgggaaataatcctgcttcggaacctgatggcgcgagggaggc

SEQ ID NO: 3783 - DNA, 495 bp, Artificial Sequence
  Oligonucleotide
gccttgccagcccgctcagaatcctgcaagtaacgtttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcaagtaacggtcgacgaaacaccatatattttggagagggaagttggctcactgttgtaggtgagtaagtcaaggctggacagctgggaacttgcaaaaaggggctggaatccagaatcctgcaagtaacgctgatggcgcgagggaggc

SEQ ID NO: 3784 - DNA, 495 bp, Artificial Sequence
  Oligonucleotide
gccttgccagcccgctcagaatcctgcgtctcctatttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgtctcctagtcgacaatgaaaaactgttttttggcagtggaacccagctctctgtcttgggtatgtaaaagacttctttcgggatagtgtatcataaggtcggagttccaggagaatcctgcgtctcctactgatggcgcgagggaggc

SEQ ID NO: 3785 - DNA, 495 bp, Artificial Sequence
  Oligonucleotide
gccttgccagcccgctcagaatcctgcagagtgtctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcagagtgtcgtcgacatcagccccagcattttggtgatgggactcgactctccatcctaggtaagttgcagaatcagggtggtatggccattgtcccttgaaggcagagttctctaatcctgcagagtgtcctgatggcgcgagggaggc

SEQ ID NO: 3786 - DNA, 495 bp, Artificial Sequence
  Oligonucleotide
gccttgccagcccgctcagaatcctgcgttccgaatttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgttccgaagtcgacataattcacccctccactttgggaacgggaccaggctcactgtgacaggtatgggggctccactcttgactcgggggtgcctgggtttgactgcaatgataatcctgcgttccgaactgatggcgcgagggaggc

SEQ ID NO: 3787 - DNA, 495 bp, Artificial Sequence
  Oligonucleotide
gccttgccagcccgctcagaatcctgccgttactttttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgccgttacttgtcgacacaatgagcagttcttcgggccagggacacggctcaccgtgctaggtaagaagggggctccaggtgggagagagggtgagcagcccagcctgcacgacccaatcctgccgttacttctgatggcgcgagggaggc

SEQ ID NO: 3788 - DNA, 495 bp, Artificial Sequence
  Oligonucleotide
gccttgccagcccgctcagaatcctgctaggagactttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgctaggagacgtcgacaccggggagctgttttttggagaaggctctaggctgaccgtactgggtaaggaggcggttggggctccggagagctccgagagggcgggatgggcagaggaatcctgctaggagacctgatggcgcgagggaggc

SEQ ID NO: 3789 - DNA, 495 bp, Artificial Sequence
  Oligonucleotide
gccttgccagcccgctcagaatcctgcgtgtctactttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgtgtctacgtcgacagatacgcagtattttggcccaggcacccggctgacagtgctcggtaagcgggggctcccgctgaagccccggaactggggagggggcgccccgggacgcaatcctgcgtgtctacctgatggcgcgagggaggc

SEQ ID NO: 3790 - DNA, 495 bp, Artificial Sequence
  Oligonucleotide
gccttgccagcccgctcagaatcctgcgtacagtgtttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcgtacagtggtcgacaaaacattcagtacttcggcgccgggacccggctctcagtgctgggtaagctggggccgccgggggaccggggacgagactgcgctcgggtttttgtgcgaatcctgcgtacagtgctgatggcgcgagggaggc

SEQ ID NO: 3791 - DNA, 495 bp, Artificial Sequence
  Oligonucleotide
gccttgccagcccgctcagaatcctgcggatcatctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcggatcatcgtcgacgagacccagtacttcgggccaggcacgcggctcctggtgctcggtgagcgcgggctgctggggcgcgggcgcgggcggcttgggtctggtttttgcggggaatcctgcggatcatcctgatggcgcgagggaggc

SEQ ID NO: 3792 - DNA, 495 bp, Artificial Sequence
  Oligonucleotide
gccttgccagcccgctcagaatcctgctattggcgtttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgctattggcggtcgacgggccaacgtcctgactttcggggccggcagcaggctgaccgtgctgggtgagttttcgcgggaccacccgggcggcgggattcaggtggaaggcggcggaatcctgctattggcgctgatggcgcgagggaggc

SEQ ID NO: 3793 - DNA, 495 bp, Artificial Sequence
  Oligonucleotide
gccttgccagcccgctcagaatcctgcaggcttgatttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagtgaaatcctgcaggcttgagtcgacacgagcagtacttcgggccgggcaccaggctcacggtcacaggtgagattcgggcgtctccccaccttccagcccctcggtccccggagtcggagggtggaatcctgcaggcttgactgatggcgcgagggaggc

SEQ ID NO: 3794 - DNA, 495 bp, Artificial Sequence
  Oligonucleotide
gccttgccagcccgctcagtgagacctgacactctctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgacactctgtcgacactgaagctttctttggacaaggcaccagactcacagttgtaggtaagacatttttcaggttcttttgcagatccgtcacagggaaaagtgggtccacagtgagacctgacactctctgatggcgcgagggaggc

SEQ ID NO: 3795 - DNA, 495 bp, Artificial Sequence
  Oligonucleotide
gccttgccagcccgctcagtgagacctttcggaacctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctttcggaacgtcgactatggctacaccttcggttcggggaccaggttaaccgttgtaggtaaggctgggggtctctaggaggggtgcgatgagggaggactctgtcctgggaaattgagacctttcggaacctgatggcgcgagggaggc

SEQ ID NO: 3796 - DNA, 495 bp, Artificial Sequence
  Oligonucleotide
gccttgccagcccgctcagtgagacctaagtaacgctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctaagtaacggtcgacgaaacaccatatattttggagagggaagttggctcactgttgtaggtgagtaagtcaaggctggacagctgggaacttgcaaaaaggggctggaatccagtgagacctaagtaacgctgatggcgcgagggaggc

SEQ ID NO: 3797 - DNA, 495 bp, Artificial Sequence
  Oligonucleotide
gccttgccagcccgctcagtgagacctgtctcctactttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgtctcctagtcgacaatgaaaaactgttttttggcagtggaacccagctctctgtcttgggtatgtaaaagacttctttcgggatagtgtatcataaggtcggagttccaggagtgagacctgtctcctactgatggcgcgagggaggc

SEQ ID NO: 3798 - DNA, 495 bp, Artificial Sequence
  Oligonucleotide
gccttgccagcccgctcagtgagacctagagtgtcctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctagagtgtcgtcgacatcagccccagcattttggtgatgggactcgactctccatcctaggtaagttgcagaatcagggtggtatggccattgtcccttgaaggcagagttctcttgagacctagagtgtcctgatggcgcgagggaggc

SEQ ID NO: 3799 - DNA, 495 bp, Artificial Sequence
  Oligonucleotide
gccttgccagcccgctcagtgagacctgttccgaactttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgttccgaagtcgacataattcacccctccactttgggaacgggaccaggctcactgtgacaggtatgggggctccactcttgactcgggggtgcctgggtttgactgcaatgattgagacctgttccgaactgatggcgcgagggaggc

SEQ ID NO: 3800 - DNA, 495 bp, Artificial Sequence
  Oligonucleotide
gccttgccagcccgctcagtgagacctcgttacttctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctcgttacttgtcgacacaatgagcagttcttcgggccagggacacggctcaccgtgctaggtaagaagggggctccaggtgggagagagggtgagcagcccagcctgcacgaccctgagacctcgttacttctgatggcgcgagggaggc

SEQ ID NO: 3801 - DNA, 495 bp, Artificial Sequence
  Oligonucleotide
gccttgccagcccgctcagtgagaccttaggagacctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagaccttaggagacgtcgacaccggggagctgttttttggagaaggctctaggctgaccgtactgggtaaggaggcggttggggctccggagagctccgagagggcgggatgggcagaggtgagaccttaggagacctgatggcgcgagggaggc

SEQ ID NO: 3802 - DNA, 495 bp, Artificial Sequence
  Oligonucleotide
gccttgccagcccgctcagtgagacctgtgtctacctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgtgtctacgtcgacagatacgcagtattttggcccaggcacccggctgacagtgctcggtaagcgggggctcccgctgaagccccggaactggggagggggcgccccgggacgctgagacctgtgtctacctgatggcgcgagggaggc

SEQ ID NO: 3803 - DNA, 495 bp, Artificial Sequence
  Oligonucleotide
gccttgccagcccgctcagtgagacctgtacagtgctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctgtacagtggtcgacaaaacattcagtacttcggcgccgggacccggctctcagtgctgggtaagctggggccgccgggggaccggggacgagactgcgctcgggtttttgtgcgtgagacctgtacagtgctgatggcgcgagggaggc

SEQ ID NO: 3804 - DNA, 495 bp, Artificial Sequence
  Oligonucleotide
gccttgccagcccgctcagtgagacctggatcatcctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctggatcatcgtcgacgagacccagtacttcgggccaggcacgcggctcctggtgctcggtgagcgcgggctgctggggcgcgggcgcgggcggcttgggtctggtttttgcggggtgagacctggatcatcctgatggcgcgagggaggc

SEQ ID NO: 3805 - DNA, 495 bp, Artificial Sequence
  Oligonucleotide
gccttgccagcccgctcagtgagaccttattggcgctttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagaccttattggcggtcgacgggccaacgtcctgactttcggggccggcagcaggctgaccgtgctgggtgagttttcgcgggaccacccgggcggcgggattcaggtggaaggcggcggtgagaccttattggcgctgatggcgcgagggaggc

SEQ ID NO: 3806 - DNA, 495 bp, Artificial Sequence
  Oligonucleotide
gccttgccagcccgctcagtgagacctaggcttgactttacaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagtgatgagacctaggcttgagtcgacacgagcagtacttcgggccgggcaccaggctcacggtcacaggtgagattcgggcgtctccccaccttccagcccctcggtccccggagtcggagggtggtgagacctaggcttgactgatggcgcgagggaggc

SEQ ID NO: 3807 - DNA, 495 bp, Artificial Sequence
  Oligonucleotide
gccttgccagcccgctcaggaatggacgacactctttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgacactctgtcgacactgaagctttctttggacaaggcaccagactcacagttgtaggtaagacatttttcaggttcttttgcagatccgtcacagggaaaagtgggtccacaggaatggacgacactctctgatggcgcgagggaggc

SEQ ID NO: 3808 - DNA, 495 bp, Artificial Sequence
  Oligonucleotide
gccttgccagcccgctcaggaatggacttcggaacttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacttcggaacgtcgactatggctacaccttcggttcggggaccaggttaaccgttgtaggtaaggctgggggtctctaggaggggtgcgatgagggaggactctgtcctgggaaatgaatggacttcggaacctgatggcgcgagggaggc

SEQ ID NO: 3809 - DNA, 495 bp, Artificial Sequence
  Oligonucleotide
gccttgccagcccgctcaggaatggacaagtaacgttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacaagtaacggtcgacgaaacaccatatattttggagagggaagttggctcactgttgtaggtgagtaagtcaaggctggacagctgggaacttgcaaaaaggggctggaatccaggaatggacaagtaacgctgatggcgcgagggaggc

SEQ ID NO: 3810 - DNA, 495 bp, Artificial Sequence
  Oligonucleotide
gccttgccagcccgctcaggaatggacgtctcctattcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgtctcctagtcgacaatgaaaaactgttttttggcagtggaacccagctctctgtcttgggtatgtaaaagacttctttcgggatagtgtatcataaggtcggagttccaggaggaatggacgtctcctactgatggcgcgagggaggc

SEQ ID NO: 3811 - DNA, 495 bp, Artificial Sequence
  Oligonucleotide
gccttgccagcccgctcaggaatggacagagtgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacagagtgtcgtcgacatcagccccagcattttggtgatgggactcgactctccatcctaggtaagttgcagaatcagggtggtatggccattgtcccttgaaggcagagttctctgaatggacagagtgtcctgatggcgcgagggaggc

SEQ ID NO: 3812 - DNA, 495 bp, Artificial Sequence
  Oligonucleotide
gccttgccagcccgctcaggaatggacgttccgaattcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgttccgaagtcgacataattcacccctccactttgggaacgggaccaggctcactgtgacaggtatgggggctccactcttgactcgggggtgcctgggtttgactgcaatgatgaatggacgttccgaactgatggcgcgagggaggc

SEQ ID NO: 3813 - DNA, 495 bp, Artificial Sequence
  Oligonucleotide
gccttgccagcccgctcaggaatggaccgttacttttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggaccgttacttgtcgacacaatgagcagttcttcgggccagggacacggctcaccgtgctaggtaagaagggggctccaggtgggagagagggtgagcagcccagcctgcacgacccgaatggaccgttacttctgatggcgcgagggaggc

SEQ ID NO: 3814 - DNA, 495 bp, Artificial Sequence
  Oligonucleotide
gccttgccagcccgctcaggaatggactaggagacttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggactaggagacgtcgacaccggggagctgttttttggagaaggctctaggctgaccgtactgggtaaggaggcggttggggctccggagagctccgagagggcgggatgggcagagggaatggactaggagacctgatggcgcgagggaggc

SEQ ID NO: 3815 - DNA, 495 bp, Artificial Sequence
  Oligonucleotide
gccttgccagcccgctcaggaatggacgtgtctacttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgtgtctacgtcgacagatacgcagtattttggcccaggcacccggctgacagtgctcggtaagcgggggctcccgctgaagccccggaactggggagggggcgccccgggacgcgaatggacgtgtctacctgatggcgcgagggaggc

SEQ ID NO: 3816 - DNA, 495 bp, Artificial Sequence
  Oligonucleotide
gccttgccagcccgctcaggaatggacgtacagtgttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacgtacagtggtcgacaaaacattcagtacttcggcgccgggacccggctctcagtgctgggtaagctggggccgccgggggaccggggacgagactgcgctcgggtttttgtgcggaatggacgtacagtgctgatggcgcgagggaggc

SEQ ID NO: 3817 - DNA, 495 bp, Artificial Sequence
  Oligonucleotide
gccttgccagcccgctcaggaatggacggatcatcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacggatcatcgtcgacgagacccagtacttcgggccaggcacgcggctcctggtgctcggtgagcgcgggctgctggggcgcgggcgcgggcggcttgggtctggtttttgcgggggaatggacggatcatcctgatggcgcgagggaggc

SEQ ID NO: 3818 - DNA, 495 bp, Artificial Sequence
  Oligonucleotide
gccttgccagcccgctcaggaatggactattggcgttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggactattggcggtcgacgggccaacgtcctgactttcggggccggcagcaggctgaccgtgctgggtgagttttcgcgggaccacccgggcggcgggattcaggtggaaggcggcgggaatggactattggcgctgatggcgcgagggaggc

SEQ ID NO: 3819 - DNA, 495 bp, Artificial Sequence
  Oligonucleotide
gccttgccagcccgctcaggaatggacaggcttgattcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagtgagaatggacaggcttgagtcgacacgagcagtacttcgggccgggcaccaggctcacggtcacaggtgagattcgggcgtctccccaccttccagcccctcggtccccggagtcggagggtgggaatggacaggcttgactgatggcgcgagggaggc

SEQ ID NO: 3820 - DNA, 495 bp, Artificial Sequence
  Oligonucleotide
gccttgccagcccgctcagagttatgcgacactctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgacactctgtcgacactgaagctttctttggacaaggcaccagactcacagttgtaggtaagacatttttcaggttcttttgcagatccgtcacagggaaaagtgggtccacagagttatgcgacactctctgatggcgcgagggaggc

SEQ ID NO: 3821 - DNA, 495 bp, Artificial Sequence
  Oligonucleotide
gccttgccagcccgctcagagttatgcttcggaaccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcttcggaacgtcgactatggctacaccttcggttcggggaccaggttaaccgttgtaggtaaggctgggggtctctaggaggggtgcgatgagggaggactctgtcctgggaaatagttatgcttcggaacctgatggcgcgagggaggc

SEQ ID NO: 3822 - DNA, 495 bp, Artificial Sequence
  Oligonucleotide
gccttgccagcccgctcagagttatgcaagtaacgcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcaagtaacggtcgacgaaacaccatatattttggagagggaagttggctcactgttgtaggtgagtaagtcaaggctggacagctgggaacttgcaaaaaggggctggaatccagagttatgcaagtaacgctgatggcgcgagggaggc

SEQ ID NO: 3823 - DNA, 495 bp, Artificial Sequence
  Oligonucleotide
gccttgccagcccgctcagagttatgcgtctcctacctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgtctcctagtcgacaatgaaaaactgttttttggcagtggaacccagctctctgtcttgggtatgtaaaagacttctttcgggatagtgtatcataaggtcggagttccaggagagttatgcgtctcctactgatggcgcgagggaggc

SEQ ID NO: 3824 - DNA, 495 bp, Artificial Sequence
  Oligonucleotide
gccttgccagcccgctcagagttatgcagagtgtccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcagagtgtcgtcgacatcagccccagcattttggtgatgggactcgactctccatcctaggtaagttgcagaatcagggtggtatggccattgtcccttgaaggcagagttctctagttatgcagagtgtcctgatggcgcgagggaggc

SEQ ID NO: 3825 - DNA, 495 bp, Artificial Sequence
  Oligonucleotide
gccttgccagcccgctcagagttatgcgttccgaacctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgttccgaagtcgacataattcacccctccactttgggaacgggaccaggctcactgtgacaggtatgggggctccactcttgactcgggggtgcctgggtttgactgcaatgatagttatgcgttccgaactgatggcgcgagggaggc

SEQ ID NO: 3826 - DNA, 495 bp, Artificial Sequence
  Oligonucleotide
gccttgccagcccgctcagagttatgccgttacttcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgccgttacttgtcgacacaatgagcagttcttcgggccagggacacggctcaccgtgctaggtaagaagggggctccaggtgggagagagggtgagcagcccagcctgcacgacccagttatgccgttacttctgatggcgcgagggaggc

SEQ ID NO: 3827 - DNA, 495 bp, Artificial Sequence
  Oligonucleotide
gccttgccagcccgctcagagttatgctaggagaccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgctaggagacgtcgacaccggggagctgttttttggagaaggctctaggctgaccgtactgggtaaggaggcggttggggctccggagagctccgagagggcgggatgggcagaggagttatgctaggagacctgatggcgcgagggaggc

SEQ ID NO: 3828 - DNA, 495 bp, Artificial Sequence
  Oligonucleotide
gccttgccagcccgctcagagttatgcgtgtctaccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgtgtctacgtcgacagatacgcagtattttggcccaggcacccggctgacagtgctcggtaagcgggggctcccgctgaagccccggaactggggagggggcgccccgggacgcagttatgcgtgtctacctgatggcgcgagggaggc

SEQ ID NO: 3829 - DNA, 495 bp, Artificial Sequence
  Oligonucleotide
gccttgccagcccgctcagagttatgcgtacagtgcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcgtacagtggtcgacaaaacattcagtacttcggcgccgggacccggctctcagtgctgggtaagctggggccgccgggggaccggggacgagactgcgctcgggtttttgtgcgagttatgcgtacagtgctgatggcgcgagggaggc

SEQ ID NO: 3830 - DNA, 495 bp, Artificial Sequence
  Oligonucleotide
gccttgccagcccgctcagagttatgcggatcatccctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcggatcatcgtcgacgagacccagtacttcgggccaggcacgcggctcctggtgctcggtgagcgcgggctgctggggcgcgggcgcgggcggcttgggtctggtttttgcggggagttatgcggatcatcctgatggcgcgagggaggc

SEQ ID NO: 3831 - DNA, 495 bp, Artificial Sequence
  Oligonucleotide
gccttgccagcccgctcagagttatgctattggcgcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgctattggcggtcgacgggccaacgtcctgactttcggggccggcagcaggctgaccgtgctgggtgagttttcgcgggaccacccgggcggcgggattcaggtggaaggcggcggagttatgctattggcgctgatggcgcgagggaggc

SEQ ID NO: 3832 - DNA, 495 bp, Artificial Sequence
  Oligonucleotide
gccttgccagcccgctcagagttatgcaggcttgacctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctctgaagttatgcaggcttgagtcgacacgagcagtacttcgggccgggcaccaggctcacggtcacaggtgagattcgggcgtctccccaccttccagcccctcggtccccggagtcggagggtggagttatgcaggcttgactgatggcgcgagggaggc

SEQ ID NO: 3833 - DNA, 495 bp, Artificial Sequence
  Oligonucleotide
gccttgccagcccgctcagcagcatatgacactctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgacactctgtcgacactgaagctttctttggacaaggcaccagactcacagttgtaggtaagacatttttcaggttcttttgcagatccgtcacagggaaaagtgggtccacagcagcatatgacactctctgatggcgcgagggaggc

SEQ ID NO: 3834 - DNA, 495 bp, Artificial Sequence
  Oligonucleotide
gccttgccagcccgctcagcagcatatttcggaacttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatttcggaacgtcgactatggctacaccttcggttcggggaccaggttaaccgttgtaggtaaggctgggggtctctaggaggggtgcgatgagggaggactctgtcctgggaaatcagcatatttcggaacctgatggcgcgagggaggc

SEQ ID NO: 3835 - DNA, 495 bp, Artificial Sequence
  Oligonucleotide
gccttgccagcccgctcagcagcatataagtaacgttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatataagtaacggtcgacgaaacaccatatattttggagagggaagttggctcactgttgtaggtgagtaagtcaaggctggacagctgggaacttgcaaaaaggggctggaatccagcagcatataagtaacgctgatggcgcgagggaggc

SEQ ID NO: 3836 - DNA, 495 bp, Artificial Sequence
  Oligonucleotide
gccttgccagcccgctcagcagcatatgtctcctattcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgtctcctagtcgacaatgaaaaactgttttttggcagtggaacccagctctctgtcttgggtatgtaaaagacttctttcgggatagtgtatcataaggtcggagttccaggagcagcatatgtctcctactgatggcgcgagggaggc

SEQ ID NO: 3837 - DNA, 495 bp, Artificial Sequence
  Oligonucleotide
gccttgccagcccgctcagcagcatatagagtgtcttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatagagtgtcgtcgacatcagccccagcattttggtgatgggactcgactctccatcctaggtaagttgcagaatcagggtggtatggccattgtcccttgaaggcagagttctctcagcatatagagtgtcctgatggcgcgagggaggc

SEQ ID NO: 3838 - DNA, 495 bp, Artificial Sequence
  Oligonucleotide
gccttgccagcccgctcagcagcatatgttccgaattcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgttccgaagtcgacataattcacccctccactttgggaacgggaccaggctcactgtgacaggtatgggggctccactcttgactcgggggtgcctgggtttgactgcaatgatcagcatatgttccgaactgatggcgcgagggaggc

SEQ ID NO: 3839 - DNA, 495 bp, Artificial Sequence
  Oligonucleotide
gccttgccagcccgctcagcagcatatcgttacttttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatcgttacttgtcgacacaatgagcagttcttcgggccagggacacggctcaccgtgctaggtaagaagggggctccaggtgggagagagggtgagcagcccagcctgcacgaccccagcatatcgttacttctgatggcgcgagggaggc

SEQ ID NO: 3840 - DNA, 495 bp, Artificial Sequence
  Oligonucleotide
gccttgccagcccgctcagcagcatattaggagacttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatattaggagacgtcgacaccggggagctgttttttggagaaggctctaggctgaccgtactgggtaaggaggcggttggggctccggagagctccgagagggcgggatgggcagaggcagcatattaggagacctgatggcgcgagggaggc

SEQ ID NO: 3841 - DNA, 495 bp, Artificial Sequence
  Oligonucleotide
gccttgccagcccgctcagcagcatatgtgtctacttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgtgtctacgtcgacagatacgcagtattttggcccaggcacccggctgacagtgctcggtaagcgggggctcccgctgaagccccggaactggggagggggcgccccgggacgccagcatatgtgtctacctgatggcgcgagggaggc

SEQ ID NO: 3842 - DNA, 495 bp, Artificial Sequence
  Oligonucleotide
gccttgccagcccgctcagcagcatatgtacagtgttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatgtacagtggtcgacaaaacattcagtacttcggcgccgggacccggctctcagtgctgggtaagctggggccgccgggggaccggggacgagactgcgctcgggtttttgtgcgcagcatatgtacagtgctgatggcgcgagggaggc

SEQ ID NO: 3843 - DNA, 495 bp, Artificial Sequence
  Oligonucleotide
gccttgccagcccgctcagcagcatatggatcatcttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatatggatcatcgtcgacgagacccagtacttcgggccaggcacgcggctcctggtgctcggtgagcgcgggctgctggggcgcgggcgcgggcggcttgggtctggtttttgcggggcagcatatggatcatcctgatggcgcgagggaggc

SEQ ID NO: 3844 - DNA, 495 bp, Artificial Sequence
  Oligonucleotide
gccttgccagcccgctcagcagcatattattggcgttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatattattggcggtcgacgggccaacgtcctgactttcggggccggcagcaggctgaccgtgctgggtgagttttcgcgggaccacccgggcggcgggattcaggtggaaggcggcggcagcatattattggcgctgatggcgcgagggaggc

SEQ ID NO: 3845 - DNA, 495 bp, Artificial Sequence
  Oligonucleotide
gccttgccagcccgctcagcagcatataggcttgattcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtgacagcatataggcttgagtcgacacgagcagtacttcgggccgggcaccaggctcacggtcacaggtgagattcgggcgtctccccaccttccagcccctcggtccccggagtcggagggtggcagcatataggcttgactgatggcgcgagggaggc

SEQ ID NO: 3846 - DNA, 495 bp, Artificial Sequence
  Oligonucleotide
gccttgccagcccgctcaggcaggattgacactctaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgacactctgtcgacactgaagctttctttggacaaggcaccagactcacagttgtaggtaagacatttttcaggttcttttgcagatccgtcacagggaaaagtgggtccacaggcaggattgacactctctgatggcgcgagggaggc

SEQ ID NO: 3847 - DNA, 495 bp, Artificial Sequence
  Oligonucleotide
gccttgccagcccgctcaggcaggattttcggaacaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattttcggaacgtcgactatggctacaccttcggttcggggaccaggttaaccgttgtaggtaaggctgggggtctctaggaggggtgcgatgagggaggactctgtcctgggaaatgcaggattttcggaacctgatggcgcgagggaggc

SEQ ID NO: 3848 - DNA, 495 bp, Artificial Sequence
  Oligonucleotide
gccttgccagcccgctcaggcaggattaagtaacgaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattaagtaacggtcgacgaaacaccatatattttggagagggaagttggctcactgttgtaggtgagtaagtcaaggctggacagctgggaacttgcaaaaaggggctggaatccaggcaggattaagtaacgctgatggcgcgagggaggc

SEQ ID NO: 3849 - DNA, 495 bp, Artificial Sequence
  Oligonucleotide
gccttgccagcccgctcaggcaggattgtctcctaaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgtctcctagtcgacaatgaaaaactgttttttggcagtggaacccagctctctgtcttgggtatgtaaaagacttctttcgggatagtgtatcataaggtcggagttccaggaggcaggattgtctcctactgatggcgcgagggaggc

SEQ ID NO: 3850 - DNA, 495 bp, Artificial Sequence
  Oligonucleotide
gccttgccagcccgctcaggcaggattagagtgtcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattagagtgtcgtcgacatcagccccagcattttggtgatgggactcgactctccatcctaggtaagttgcagaatcagggtggtatggccattgtcccttgaaggcagagttctctgcaggattagagtgtcctgatggcgcgagggaggc

SEQ ID NO: 3851 - DNA, 495 bp, Artificial Sequence
  Oligonucleotide
gccttgccagcccgctcaggcaggattgttccgaaaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgttccgaagtcgacataattcacccctccactttgggaacgggaccaggctcactgtgacaggtatgggggctccactcttgactcgggggtgcctgggtttgactgcaatgatgcaggattgttccgaactgatggcgcgagggaggc

SEQ ID NO: 3852 - DNA, 495 bp, Artificial Sequence
  Oligonucleotide
gccttgccagcccgctcaggcaggattcgttacttaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattcgttacttgtcgacacaatgagcagttcttcgggccagggacacggctcaccgtgctaggtaagaagggggctccaggtgggagagagggtgagcagcccagcctgcacgacccgcaggattcgttacttctgatggcgcgagggaggc

SEQ ID NO: 3853 - DNA, 495 bp, Artificial Sequence
  Oligonucleotide
gccttgccagcccgctcaggcaggatttaggagacaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggatttaggagacgtcgacaccggggagctgttttttggagaaggctctaggctgaccgtactgggtaaggaggcggttggggctccggagagctccgagagggcgggatgggcagagggcaggatttaggagacctgatggcgcgagggaggc

SEQ ID NO: 3854 - DNA, 495 bp, Artificial Sequence
  Oligonucleotide
gccttgccagcccgctcaggcaggattgtgtctacaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgtgtctacgtcgacagatacgcagtattttggcccaggcacccggctgacagtgctcggtaagcgggggctcccgctgaagccccggaactggggagggggcgccccgggacgcgcaggattgtgtctacctgatggcgcgagggaggc

SEQ ID NO: 3855 - DNA, 495 bp, Artificial Sequence
  Oligonucleotide
gccttgccagcccgctcaggcaggattgtacagtgaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattgtacagtggtcgacaaaacattcagtacttcggcgccgggacccggctctcagtgctgggtaagctggggccgccgggggaccggggacgagactgcgctcgggtttttgtgcggcaggattgtacagtgctgatggcgcgagggaggc

SEQ ID NO: 3856 - DNA, 495 bp, Artificial Sequence
  Oligonucleotide
gccttgccagcccgctcaggcaggattggatcatcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattggatcatcgtcgacgagacccagtacttcgggccaggcacgcggctcctggtgctcggtgagcgcgggctgctggggcgcgggcgcgggcggcttgggtctggtttttgcgggggcaggattggatcatcctgatggcgcgagggaggc

SEQ ID NO: 3857 - DNA, 495 bp, Artificial Sequence
  Oligonucleotide
gccttgccagcccgctcaggcaggatttattggcgaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggatttattggcggtcgacgggccaacgtcctgactttcggggccggcagcaggctgaccgtgctgggtgagttttcgcgggaccacccgggcggcgggattcaggtggaaggcggcgggcaggatttattggcgctgatggcgcgagggaggc

SEQ ID NO: 3858 - DNA, 495 bp, Artificial Sequence
  Oligonucleotide
gccttgccagcccgctcaggcaggattaggcttgaaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctgagcaggattaggcttgagtcgacacgagcagtacttcgggccgggcaccaggctcacggtcacaggtgagattcgggcgtctccccaccttccagcccctcggtccccggagtcggagggtgggcaggattaggcttgactgatggcgcgagggaggc

SEQ ID NO: 3859 - DNA, 495 bp, Artificial Sequence
  Oligonucleotide
gccttgccagcccgctcagaggtctcagacactctctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagacactctgtcgacactgaagctttctttggacaaggcaccagactcacagttgtaggtaagacatttttcaggttcttttgcagatccgtcacagggaaaagtgggtccacagaggtctcagacactctctgatggcgcgagggaggc

SEQ ID NO: 3860 - DNA, 495 bp, Artificial Sequence
  Oligonucleotide
gccttgccagcccgctcagaggtctcattcggaacctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcattcggaacgtcgactatggctacaccttcggttcggggaccaggttaaccgttgtaggtaaggctgggggtctctaggaggggtgcgatgagggaggactctgtcctgggaaataggtctcattcggaacctgatggcgcgagggaggc

SEQ ID NO: 3861 - DNA, 495 bp, Artificial Sequence
  Oligonucleotide
gccttgccagcccgctcagaggtctcaaagtaacgctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaaagtaacggtcgacgaaacaccatatattttggagagggaagttggctcactgttgtaggtgagtaagtcaaggctggacagctgggaacttgcaaaaaggggctggaatccagaggtctcaaagtaacgctgatggcgcgagggaggc

SEQ ID NO: 3862 - DNA, 495 bp, Artificial Sequence
  Oligonucleotide
gccttgccagcccgctcagaggtctcagtctcctactccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagtctcctagtcgacaatgaaaaactgttttttggcagtggaacccagctctctgtcttgggtatgtaaaagacttctttcgggatagtgtatcataaggtcggagttccaggagaggtctcagtctcctactgatggcgcgagggaggc

SEQ ID NO: 3863 - DNA, 495 bp, Artificial Sequence
  Oligonucleotide
gccttgccagcccgctcagaggtctcaagagtgtcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaagagtgtcgtcgacatcagccccagcattttggtgatgggactcgactctccatcctaggtaagttgcagaatcagggtggtatggccattgtcccttgaaggcagagttctctaggtctcaagagtgtcctgatggcgcgagggaggc

SEQ ID NO: 3864 - DNA, 495 bp, Artificial Sequence
  Oligonucleotide
gccttgccagcccgctcagaggtctcagttccgaactccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagttccgaagtcgacataattcacccctccactttgggaacgggaccaggctcactgtgacaggtatgggggctccactcttgactcgggggtgcctgggtttgactgcaatgataggtctcagttccgaactgatggcgcgagggaggc

SEQ ID NO: 3865 - DNA, 495 bp, Artificial Sequence
  Oligonucleotide
gccttgccagcccgctcagaggtctcacgttacttctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcacgttacttgtcgacacaatgagcagttcttcgggccagggacacggctcaccgtgctaggtaagaagggggctccaggtgggagagagggtgagcagcccagcctgcacgacccaggtctcacgttacttctgatggcgcgagggaggc

SEQ ID NO: 3866 - DNA, 495 bp, Artificial Sequence
  Oligonucleotide
gccttgccagcccgctcagaggtctcataggagacctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcataggagacgtcgacaccggggagctgttttttggagaaggctctaggctgaccgtactgggtaaggaggcggttggggctccggagagctccgagagggcgggatgggcagaggaggtctcataggagacctgatggcgcgagggaggc

SEQ ID NO: 3867 - DNA, 495 bp, Artificial Sequence
  Oligonucleotide
gccttgccagcccgctcagaggtctcagtgtctacctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagtgtctacgtcgacagatacgcagtattttggcccaggcacccggctgacagtgctcggtaagcgggggctcccgctgaagccccggaactggggagggggcgccccgggacgcaggtctcagtgtctacctgatggcgcgagggaggc

SEQ ID NO: 3868 - DNA, 495 bp, Artificial Sequence
  Oligonucleotide
gccttgccagcccgctcagaggtctcagtacagtgctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcagtacagtggtcgacaaaacattcagtacttcggcgccgggacccggctctcagtgctgggtaagctggggccgccgggggaccggggacgagactgcgctcgggtttttgtgcgaggtctcagtacagtgctgatggcgcgagggaggc

SEQ ID NO: 3869 - DNA, 495 bp, Artificial Sequence
  Oligonucleotide
gccttgccagcccgctcagaggtctcaggatcatcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaggatcatcgtcgacgagacccagtacttcgggccaggcacgcggctcctggtgctcggtgagcgcgggctgctggggcgcgggcgcgggcggcttgggtctggtttttgcggggaggtctcaggatcatcctgatggcgcgagggaggc

SEQ ID NO: 3870 - DNA, 495 bp, Artificial Sequence
  Oligonucleotide
gccttgccagcccgctcagaggtctcatattggcgctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcatattggcggtcgacgggccaacgtcctgactttcggggccggcagcaggctgaccgtgctgggtgagttttcgcgggaccacccgggcggcgggattcaggtggaaggcggcggaggtctcatattggcgctgatggcgcgagggaggc

SEQ ID NO: 3871 - DNA, 495 bp, Artificial Sequence
  Oligonucleotide
gccttgccagcccgctcagaggtctcaaggcttgactccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagtgaaggtctcaaggcttgagtcgacacgagcagtacttcgggccgggcaccaggctcacggtcacaggtgagattcgggcgtctccccaccttccagcccctcggtccccggagtcggagggtggaggtctcaaggcttgactgatggcgcgagggaggc

SEQ ID NO: 3872 - DNA, 495 bp, Artificial Sequence
  Oligonucleotide
gccttgccagcccgctcaggtccattcgacactctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgacactctgtcgacactgaagctttctttggacaaggcaccagactcacagttgtaggtaagacatttttcaggttcttttgcagatccgtcacagggaaaagtgggtccacaggtccattcgacactctctgatggcgcgagggaggc

SEQ ID NO: 3873 - DNA, 495 bp, Artificial Sequence
  Oligonucleotide
gccttgccagcccgctcaggtccattcttcggaacttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcttcggaacgtcgactatggctacaccttcggttcggggaccaggttaaccgttgtaggtaaggctgggggtctctaggaggggtgcgatgagggaggactctgtcctgggaaatgtccattcttcggaacctgatggcgcgagggaggc

SEQ ID NO: 3874 - DNA, 495 bp, Artificial Sequence
  Oligonucleotide
gccttgccagcccgctcaggtccattcaagtaacgttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcaagtaacggtcgacgaaacaccatatattttggagagggaagttggctcactgttgtaggtgagtaagtcaaggctggacagctgggaacttgcaaaaaggggctggaatccaggtccattcaagtaacgctgatggcgcgagggaggc

SEQ ID NO: 3875 - DNA, 495 bp, Artificial Sequence
  Oligonucleotide
gccttgccagcccgctcaggtccattcgtctcctattgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgtctcctagtcgacaatgaaaaactgttttttggcagtggaacccagctctctgtcttgggtatgtaaaagacttctttcgggatagtgtatcataaggtcggagttccaggaggtccattcgtctcctactgatggcgcgagggaggc

SEQ ID NO: 3876 - DNA, 495 bp, Artificial Sequence
  Oligonucleotide
gccttgccagcccgctcaggtccattcagagtgtcttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcagagtgtcgtcgacatcagccccagcattttggtgatgggactcgactctccatcctaggtaagttgcagaatcagggtggtatggccattgtcccttgaaggcagagttctctgtccattcagagtgtcctgatggcgcgagggaggc

SEQ ID NO: 3877 - DNA, 495 bp, Artificial Sequence
  Oligonucleotide
gccttgccagcccgctcaggtccattcgttccgaattgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgttccgaagtcgacataattcacccctccactttgggaacgggaccaggctcactgtgacaggtatgggggctccactcttgactcgggggtgcctgggtttgactgcaatgatgtccattcgttccgaactgatggcgcgagggaggc

SEQ ID NO: 3878 - DNA, 495 bp, Artificial Sequence
  Oligonucleotide
gccttgccagcccgctcaggtccattccgttacttttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattccgttacttgtcgacacaatgagcagttcttcgggccagggacacggctcaccgtgctaggtaagaagggggctccaggtgggagagagggtgagcagcccagcctgcacgacccgtccattccgttacttctgatggcgcgagggaggc

SEQ ID NO: 3879 - DNA, 495 bp, Artificial Sequence
  Oligonucleotide
gccttgccagcccgctcaggtccattctaggagacttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattctaggagacgtcgacaccggggagctgttttttggagaaggctctaggctgaccgtactgggtaaggaggcggttggggctccggagagctccgagagggcgggatgggcagagggtccattctaggagacctgatggcgcgagggaggc

SEQ ID NO: 3880 - DNA, 495 bp, Artificial Sequence
  Oligonucleotide
gccttgccagcccgctcaggtccattcgtgtctacttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgtgtctacgtcgacagatacgcagtattttggcccaggcacccggctgacagtgctcggtaagcgggggctcccgctgaagccccggaactggggagggggcgccccgggacgcgtccattcgtgtctacctgatggcgcgagggaggc

SEQ ID NO: 3881 - DNA, 495 bp, Artificial Sequence
  Oligonucleotide
gccttgccagcccgctcaggtccattcgtacagtgttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcgtacagtggtcgacaaaacattcagtacttcggcgccgggacccggctctcagtgctgggtaagctggggccgccgggggaccggggacgagactgcgctcgggtttttgtgcggtccattcgtacagtgctgatggcgcgagggaggc

SEQ ID NO: 3882 - DNA, 495 bp, Artificial Sequence
  Oligonucleotide
gccttgccagcccgctcaggtccattcggatcatcttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcggatcatcgtcgacgagacccagtacttcgggccaggcacgcggctcctggtgctcggtgagcgcgggctgctggggcgcgggcgcgggcggcttgggtctggtttttgcgggggtccattcggatcatcctgatggcgcgagggaggc

SEQ ID NO: 3883 - DNA, 495 bp, Artificial Sequence
  Oligonucleotide
gccttgccagcccgctcaggtccattctattggcgttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattctattggcggtcgacgggccaacgtcctgactttcggggccggcagcaggctgaccgtgctgggtgagttttcgcgggaccacccgggcggcgggattcaggtggaaggcggcgggtccattctattggcgctgatggcgcgagggaggc

SEQ ID NO: 3884 - DNA, 495 bp, Artificial Sequence
  Oligonucleotide
gccttgccagcccgctcaggtccattcaggcttgattgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggatgagtccattcaggcttgagtcgacacgagcagtacttcgggccgggcaccaggctcacggtcacaggtgagattcgggcgtctccccaccttccagcccctcggtccccggagtcggagggtgggtccattcaggcttgactgatggcgcgagggaggc

SEQ ID NO: 3885 - DNA, 495 bp, Artificial Sequence
  Oligonucleotide
gccttgccagcccgctcagactatgacgacactcttcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgacactctgtcgacactgaagctttctttggacaaggcaccagactcacagttgtaggtaagacatttttcaggttcttttgcagatccgtcacagggaaaagtgggtccacagactatgacgacactctctgatggcgcgagggaggc

SEQ ID NO: 3886 - DNA, 495 bp, Artificial Sequence
  Oligonucleotide
gccttgccagcccgctcagactatgacttcggaactcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacttcggaacgtcgactatggctacaccttcggttcggggaccaggttaaccgttgtaggtaaggctgggggtctctaggaggggtgcgatgagggaggactctgtcctgggaaatactatgacttcggaacctgatggcgcgagggaggc

SEQ ID NO: 3887 - DNA, 495 bp, Artificial Sequence
  Oligonucleotide
gccttgccagcccgctcagactatgacaagtaacgtcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacaagtaacggtcgacgaaacaccatatattttggagagggaagttggctcactgttgtaggtgagtaagtcaaggctggacagctgggaacttgcaaaaaggggctggaatccagactatgacaagtaacgctgatggcgcgagggaggc

SEQ ID NO: 3888 - DNA, 495 bp, Artificial Sequence
  Oligonucleotide
gccttgccagcccgctcagactatgacgtctcctatcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgtctcctagtcgacaatgaaaaactgttttttggcagtggaacccagctctctgtcttgggtatgtaaaagacttctttcgggatagtgtatcataaggtcggagttccaggagactatgacgtctcctactgatggcgcgagggaggc

SEQ ID NO: 3889 - DNA, 495 bp, Artificial Sequence
  Oligonucleotide
gccttgccagcccgctcagactatgacagagtgtctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacagagtgtcgtcgacatcagccccagcattttggtgatgggactcgactctccatcctaggtaagttgcagaatcagggtggtatggccattgtcccttgaaggcagagttctctactatgacagagtgtcctgatggcgcgagggaggc

SEQ ID NO: 3890 - DNA, 495 bp, Artificial Sequence
  Oligonucleotide
gccttgccagcccgctcagactatgacgttccgaatcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgttccgaagtcgacataattcacccctccactttgggaacgggaccaggctcactgtgacaggtatgggggctccactcttgactcgggggtgcctgggtttgactgcaatgatactatgacgttccgaactgatggcgcgagggaggc

SEQ ID NO: 3891 - DNA, 495 bp, Artificial Sequence
  Oligonucleotide
gccttgccagcccgctcagactatgaccgttactttcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgaccgttacttgtcgacacaatgagcagttcttcgggccagggacacggctcaccgtgctaggtaagaagggggctccaggtgggagagagggtgagcagcccagcctgcacgacccactatgaccgttacttctgatggcgcgagggaggc

SEQ ID NO: 3892 - DNA, 495 bp, Artificial Sequence
  Oligonucleotide
gccttgccagcccgctcagactatgactaggagactcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgactaggagacgtcgacaccggggagctgttttttggagaaggctctaggctgaccgtactgggtaaggaggcggttggggctccggagagctccgagagggcgggatgggcagaggactatgactaggagacctgatggcgcgagggaggc

SEQ ID NO: 3893 - DNA, 495 bp, Artificial Sequence
  Oligonucleotide
gccttgccagcccgctcagactatgacgtgtctactcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgtgtctacgtcgacagatacgcagtattttggcccaggcacccggctgacagtgctcggtaagcgggggctcccgctgaagccccggaactggggagggggcgccccgggacgcactatgacgtgtctacctgatggcgcgagggaggc

SEQ ID NO: 3894 - DNA, 495 bp, Artificial Sequence
  Oligonucleotide
gccttgccagcccgctcagactatgacgtacagtgtcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacgtacagtggtcgacaaaacattcagtacttcggcgccgggacccggctctcagtgctgggtaagctggggccgccgggggaccggggacgagactgcgctcgggtttttgtgcgactatgacgtacagtgctgatggcgcgagggaggc

SEQ ID NO: 3895 - DNA, 495 bp, Artificial Sequence
  Oligonucleotide
gccttgccagcccgctcagactatgacggatcatctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacggatcatcgtcgacgagacccagtacttcgggccaggcacgcggctcctggtgctcggtgagcgcgggctgctggggcgcgggcgcgggcggcttgggtctggtttttgcggggactatgacggatcatcctgatggcgcgagggaggc

SEQ ID NO: 3896 - DNA, 495 bp, Artificial Sequence
  Oligonucleotide
gccttgccagcccgctcagactatgactattggcgtcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgactattggcggtcgacgggccaacgtcctgactttcggggccggcagcaggctgaccgtgctgggtgagttttcgcgggaccacccgggcggcgggattcaggtggaaggcggcggactatgactattggcgctgatggcgcgagggaggc

SEQ ID NO: 3897 - DNA, 495 bp, Artificial Sequence
  Oligonucleotide
gccttgccagcccgctcagactatgacaggcttgatcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtgaactatgacaggcttgagtcgacacgagcagtacttcgggccgggcaccaggctcacggtcacaggtgagattcgggcgtctccccaccttccagcccctcggtccccggagtcggagggtggactatgacaggcttgactgatggcgcgagggaggc

SEQ ID NO: 3898 - DNA, 495 bp, Artificial Sequence
  Oligonucleotide
gccttgccagcccgctcagtccatgtggacactctatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggacactctgtcgacactgaagctttctttggacaaggcaccagactcacagttgtaggtaagacatttttcaggttcttttgcagatccgtcacagggaaaagtgggtccacagtccatgtggacactctctgatggcgcgagggaggc

SEQ ID NO: 3899 - DNA, 495 bp, Artificial Sequence
  Oligonucleotide
gccttgccagcccgctcagtccatgtgttcggaacatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgttcggaacgtcgactatggctacaccttcggttcggggaccaggttaaccgttgtaggtaaggctgggggtctctaggaggggtgcgatgagggaggactctgtcctgggaaattccatgtgttcggaacctgatggcgcgagggaggc

SEQ ID NO: 3900 - DNA, 495 bp, Artificial Sequence
  Oligonucleotide
gccttgccagcccgctcagtccatgtgaagtaacgatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgaagtaacggtcgacgaaacaccatatattttggagagggaagttggctcactgttgtaggtgagtaagtcaaggctggacagctgggaacttgcaaaaaggggctggaatccagtccatgtgaagtaacgctgatggcgcgagggaggc

SEQ ID NO: 3901 - DNA, 495 bp, Artificial Sequence
  Oligonucleotide
gccttgccagcccgctcagtccatgtggtctcctaatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggtctcctagtcgacaatgaaaaactgttttttggcagtggaacccagctctctgtcttgggtatgtaaaagacttctttcgggatagtgtatcataaggtcggagttccaggagtccatgtggtctcctactgatggcgcgagggaggc

SEQ ID NO: 3902 - DNA, 495 bp, Artificial Sequence
  Oligonucleotide
gccttgccagcccgctcagtccatgtgagagtgtcatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgagagtgtcgtcgacatcagccccagcattttggtgatgggactcgactctccatcctaggtaagttgcagaatcagggtggtatggccattgtcccttgaaggcagagttctcttccatgtgagagtgtcctgatggcgcgagggaggc

SEQ ID NO: 3903 - DNA, 495 bp, Artificial Sequence
  Oligonucleotide
gccttgccagcccgctcagtccatgtggttccgaaatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggttccgaagtcgacataattcacccctccactttgggaacgggaccaggctcactgtgacaggtatgggggctccactcttgactcgggggtgcctgggtttgactgcaatgattccatgtggttccgaactgatggcgcgagggaggc

SEQ ID NO: 3904 - DNA, 495 bp, Artificial Sequence
  Oligonucleotide
gccttgccagcccgctcagtccatgtgcgttacttatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgcgttacttgtcgacacaatgagcagttcttcgggccagggacacggctcaccgtgctaggtaagaagggggctccaggtgggagagagggtgagcagcccagcctgcacgaccctccatgtgcgttacttctgatggcgcgagggaggc

SEQ ID NO: 3905 - DNA, 495 bp, Artificial Sequence
  Oligonucleotide
gccttgccagcccgctcagtccatgtgtaggagacatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgtaggagacgtcgacaccggggagctgttttttggagaaggctctaggctgaccgtactgggtaaggaggcggttggggctccggagagctccgagagggcgggatgggcagaggtccatgtgtaggagacctgatggcgcgagggaggc

SEQ ID NO: 3906 - DNA, 495 bp, Artificial Sequence
  Oligonucleotide
gccttgccagcccgctcagtccatgtggtgtctacatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggtgtctacgtcgacagatacgcagtattttggcccaggcacccggctgacagtgctcggtaagcgggggctcccgctgaagccccggaactggggagggggcgccccgggacgctccatgtggtgtctacctgatggcgcgagggaggc

SEQ ID NO: 3907 - DNA, 495 bp, Artificial Sequence
  Oligonucleotide
gccttgccagcccgctcagtccatgtggtacagtgatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtggtacagtggtcgacaaaacattcagtacttcggcgccgggacccggctctcagtgctgggtaagctggggccgccgggggaccggggacgagactgcgctcgggtttttgtgcgtccatgtggtacagtgctgatggcgcgagggaggc

SEQ ID NO: 3908 - DNA, 495 bp, Artificial Sequence
  Oligonucleotide
gccttgccagcccgctcagtccatgtgggatcatcatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgggatcatcgtcgacgagacccagtacttcgggccaggcacgcggctcctggtgctcggtgagcgcgggctgctggggcgcgggcgcgggcggcttgggtctggtttttgcggggtccatgtgggatcatcctgatggcgcgagggaggc

SEQ ID NO: 3909 - DNA, 495 bp, Artificial Sequence
  Oligonucleotide
gccttgccagcccgctcagtccatgtgtattggcgatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgtattggcggtcgacgggccaacgtcctgactttcggggccggcagcaggctgaccgtgctgggtgagttttcgcgggaccacccgggcggcgggattcaggtggaaggcggcggtccatgtgtattggcgctgatggcgcgagggaggc

SEQ ID NO: 3910 - DNA, 495 bp, Artificial Sequence
  Oligonucleotide
gccttgccagcccgctcagtccatgtgaggcttgaatttccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagttgatccatgtgaggcttgagtcgacacgagcagtacttcgggccgggcaccaggctcacggtcacaggtgagattcgggcgtctccccaccttccagcccctcggtccccggagtcggagggtggtccatgtgaggcttgactgatggcgcgagggaggc

SEQ ID NO: 3911 - DNA, 495 bp, Artificial Sequence
  Oligonucleotide
gccttgccagcccgctcagatggtcaagacactcttcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagacactctgtcgacactgaagctttctttggacaaggcaccagactcacagttgtaggtaagacatttttcaggttcttttgcagatccgtcacagggaaaagtgggtccacagatggtcaagacactctctgatggcgcgagggaggc

SEQ ID NO: 3912 - DNA, 495 bp, Artificial Sequence
  Oligonucleotide
gccttgccagcccgctcagatggtcaattcggaactcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaattcggaacgtcgactatggctacaccttcggttcggggaccaggttaaccgttgtaggtaaggctgggggtctctaggaggggtgcgatgagggaggactctgtcctgggaaatatggtcaattcggaacctgatggcgcgagggaggc

SEQ ID NO: 3913 - DNA, 495 bp, Artificial Sequence
  Oligonucleotide
gccttgccagcccgctcagatggtcaaaagtaacgtcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaaagtaacggtcgacgaaacaccatatattttggagagggaagttggctcactgttgtaggtgagtaagtcaaggctggacagctgggaacttgcaaaaaggggctggaatccagatggtcaaaagtaacgctgatggcgcgagggaggc

SEQ ID NO: 3914 - DNA, 495 bp, Artificial Sequence
  Oligonucleotide
gccttgccagcccgctcagatggtcaagtctcctatcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagtctcctagtcgacaatgaaaaactgttttttggcagtggaacccagctctctgtcttgggtatgtaaaagacttctttcgggatagtgtatcataaggtcggagttccaggagatggtcaagtctcctactgatggcgcgagggaggc

SEQ ID NO: 3915 - DNA, 495 bp, Artificial Sequence
  Oligonucleotide
gccttgccagcccgctcagatggtcaaagagtgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaagagtgtcgtcgacatcagccccagcattttggtgatgggactcgactctccatcctaggtaagttgcagaatcagggtggtatggccattgtcccttgaaggcagagttctctatggtcaaagagtgtcctgatggcgcgagggaggc

SEQ ID NO: 3916 - DNA, 495 bp, Artificial Sequence
  Oligonucleotide
gccttgccagcccgctcagatggtcaagttccgaatcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagttccgaagtcgacataattcacccctccactttgggaacgggaccaggctcactgtgacaggtatgggggctccactcttgactcgggggtgcctgggtttgactgcaatgatatggtcaagttccgaactgatggcgcgagggaggc

SEQ ID NO: 3917 - DNA, 495 bp, Artificial Sequence
  Oligonucleotide
gccttgccagcccgctcagatggtcaacgttactttcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaacgttacttgtcgacacaatgagcagttcttcgggccagggacacggctcaccgtgctaggtaagaagggggctccaggtgggagagagggtgagcagcccagcctgcacgacccatggtcaacgttacttctgatggcgcgagggaggc

SEQ ID NO: 3918 - DNA, 495 bp, Artificial Sequence
  Oligonucleotide
gccttgccagcccgctcagatggtcaataggagactcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaataggagacgtcgacaccggggagctgttttttggagaaggctctaggctgaccgtactgggtaaggaggcggttggggctccggagagctccgagagggcgggatgggcagaggatggtcaataggagacctgatggcgcgagggaggc

SEQ ID NO: 3919 - DNA, 495 bp, Artificial Sequence
  Oligonucleotide
gccttgccagcccgctcagatggtcaagtgtctactcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagtgtctacgtcgacagatacgcagtattttggcccaggcacccggctgacagtgctcggtaagcgggggctcccgctgaagccccggaactggggagggggcgccccgggacgcatggtcaagtgtctacctgatggcgcgagggaggc

SEQ ID NO: 3920 - DNA, 495 bp, Artificial Sequence
  Oligonucleotide
gccttgccagcccgctcagatggtcaagtacagtgtcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaagtacagtggtcgacaaaacattcagtacttcggcgccgggacccggctctcagtgctgggtaagctggggccgccgggggaccggggacgagactgcgctcgggtttttgtgcgatggtcaagtacagtgctgatggcgcgagggaggc

SEQ ID NO: 3921 - DNA, 495 bp, Artificial Sequence
  Oligonucleotide
gccttgccagcccgctcagatggtcaaggatcatctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaggatcatcgtcgacgagacccagtacttcgggccaggcacgcggctcctggtgctcggtgagcgcgggctgctggggcgcgggcgcgggcggcttgggtctggtttttgcggggatggtcaaggatcatcctgatggcgcgagggaggc

SEQ ID NO: 3922 - DNA, 495 bp, Artificial Sequence
  Oligonucleotide
gccttgccagcccgctcagatggtcaatattggcgtcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaatattggcggtcgacgggccaacgtcctgactttcggggccggcagcaggctgaccgtgctgggtgagttttcgcgggaccacccgggcggcgggattcaggtggaaggcggcggatggtcaatattggcgctgatggcgcgagggaggc

SEQ ID NO: 3923 - DNA, 495 bp, Artificial Sequence
  Oligonucleotide
gccttgccagcccgctcagatggtcaaaggcttgatcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggtcaaaggcttgagtcgacacgagcagtacttcgggccgggcaccaggctcacggtcacaggtgagattcgggcgtctccccaccttccagcccctcggtccccggagtcggagggtggatggtcaaaggcttgactgatggcgcgagggaggc

SEQ ID NO: 3924 - DNA, 495 bp, Artificial Sequence
  Oligonucleotide
gccttgccagcccgctcagcaagtcacgacactctccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgacactctgtcgacactgaagctttctttggacaaggcaccagactcacagttgtaggtaagacatttttcaggttcttttgcagatccgtcacagggaaaagtgggtccacagcaagtcacgacactctctgatggcgcgagggaggc

SEQ ID NO: 3925 - DNA, 495 bp, Artificial Sequence
  Oligonucleotide
gccttgccagcccgctcagcaagtcacttcggaacccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacttcggaacgtcgactatggctacaccttcggttcggggaccaggttaaccgttgtaggtaaggctgggggtctctaggaggggtgcgatgagggaggactctgtcctgggaaatcaagtcacttcggaacctgatggcgcgagggaggc

SEQ ID NO: 3926 - DNA, 495 bp, Artificial Sequence
  Oligonucleotide
gccttgccagcccgctcagcaagtcacaagtaacgccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacaagtaacggtcgacgaaacaccatatattttggagagggaagttggctcactgttgtaggtgagtaagtcaaggctggacagctgggaacttgcaaaaaggggctggaatccagcaagtcacaagtaacgctgatggcgcgagggaggc

SEQ ID NO: 3927 - DNA, 495 bp, Artificial Sequence
  Oligonucleotide
gccttgccagcccgctcagcaagtcacgtctcctaccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgtctcctagtcgacaatgaaaaactgttttttggcagtggaacccagctctctgtcttgggtatgtaaaagacttctttcgggatagtgtatcataaggtcggagttccaggagcaagtcacgtctcctactgatggcgcgagggaggc

SEQ ID NO: 3928 - DNA, 495 bp, Artificial Sequence
  Oligonucleotide
gccttgccagcccgctcagcaagtcacagagtgtcccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacagagtgtcgtcgacatcagccccagcattttggtgatgggactcgactctccatcctaggtaagttgcagaatcagggtggtatggccattgtcccttgaaggcagagttctctcaagtcacagagtgtcctgatggcgcgagggaggc

SEQ ID NO: 3929 - DNA, 495 bp, Artificial Sequence
  Oligonucleotide
gccttgccagcccgctcagcaagtcacgttccgaaccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgttccgaagtcgacataattcacccctccactttgggaacgggaccaggctcactgtgacaggtatgggggctccactcttgactcgggggtgcctgggtttgactgcaatgatcaagtcacgttccgaactgatggcgcgagggaggc

SEQ ID NO: 3930 - DNA, 495 bp, Artificial Sequence
  Oligonucleotide
gccttgccagcccgctcagcaagtcaccgttacttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcaccgttacttgtcgacacaatgagcagttcttcgggccagggacacggctcaccgtgctaggtaagaagggggctccaggtgggagagagggtgagcagcccagcctgcacgaccccaagtcaccgttacttctgatggcgcgagggaggc

SEQ ID NO: 3931 - DNA, 495 bp, Artificial Sequence
  Oligonucleotide
gccttgccagcccgctcagcaagtcactaggagacccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcactaggagacgtcgacaccggggagctgttttttggagaaggctctaggctgaccgtactgggtaaggaggcggttggggctccggagagctccgagagggcgggatgggcagaggcaagtcactaggagacctgatggcgcgagggaggc

SEQ ID NO: 3932 - DNA, 495 bp, Artificial Sequence
  Oligonucleotide
gccttgccagcccgctcagcaagtcacgtgtctacccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgtgtctacgtcgacagatacgcagtattttggcccaggcacccggctgacagtgctcggtaagcgggggctcccgctgaagccccggaactggggagggggcgccccgggacgccaagtcacgtgtctacctgatggcgcgagggaggc

SEQ ID NO: 3933 - DNA, 495 bp, Artificial Sequence
  Oligonucleotide
gccttgccagcccgctcagcaagtcacgtacagtgccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacgtacagtggtcgacaaaacattcagtacttcggcgccgggacccggctctcagtgctgggtaagctggggccgccgggggaccggggacgagactgcgctcgggtttttgtgcgcaagtcacgtacagtgctgatggcgcgagggaggc

SEQ ID NO: 3934 - DNA, 495 bp, Artificial Sequence
  Oligonucleotide
gccttgccagcccgctcagcaagtcacggatcatcccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacggatcatcgtcgacgagacccagtacttcgggccaggcacgcggctcctggtgctcggtgagcgcgggctgctggggcgcgggcgcgggcggcttgggtctggtttttgcggggcaagtcacggatcatcctgatggcgcgagggaggc

SEQ ID NO: 3935 - DNA, 495 bp, Artificial Sequence
  Oligonucleotide
gccttgccagcccgctcagcaagtcactattggcgccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcactattggcggtcgacgggccaacgtcctgactttcggggccggcagcaggctgaccgtgctgggtgagttttcgcgggaccacccgggcggcgggattcaggtggaaggcggcggcaagtcactattggcgctgatggcgcgagggaggc

SEQ ID NO: 3936 - DNA, 495 bp, Artificial Sequence
  Oligonucleotide
gccttgccagcccgctcagcaagtcacaggcttgaccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagtgacaagtcacaggcttgagtcgacacgagcagtacttcgggccgggcaccaggctcacggtcacaggtgagattcgggcgtctccccaccttccagcccctcggtccccggagtcggagggtggcaagtcacaggcttgactgatggcgcgagggaggc

SEQ ID NO: 3937 - DNA, 495 bp, Artificial Sequence
  Oligonucleotide
gccttgccagcccgctcaggatggcttgacactctttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgacactctgtcgacactgaagctttctttggacaaggcaccagactcacagttgtaggtaagacatttttcaggttcttttgcagatccgtcacagggaaaagtgggtccacaggatggcttgacactctctgatggcgcgagggaggc

SEQ ID NO: 3938 - DNA, 495 bp, Artificial Sequence
  Oligonucleotide
gccttgccagcccgctcaggatggcttttcggaacttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttttcggaacgtcgactatggctacaccttcggttcggggaccaggttaaccgttgtaggtaaggctgggggtctctaggaggggtgcgatgagggaggactctgtcctgggaaatgatggcttttcggaacctgatggcgcgagggaggc

SEQ ID NO: 3939 - DNA, 495 bp, Artificial Sequence
  Oligonucleotide
gccttgccagcccgctcaggatggcttaagtaacgttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttaagtaacggtcgacgaaacaccatatattttggagagggaagttggctcactgttgtaggtgagtaagtcaaggctggacagctgggaacttgcaaaaaggggctggaatccaggatggcttaagtaacgctgatggcgcgagggaggc

SEQ ID NO: 3940 - DNA, 495 bp, Artificial Sequence
  Oligonucleotide
gccttgccagcccgctcaggatggcttgtctcctattcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgtctcctagtcgacaatgaaaaactgttttttggcagtggaacccagctctctgtcttgggtatgtaaaagacttctttcgggatagtgtatcataaggtcggagttccaggaggatggcttgtctcctactgatggcgcgagggaggc

SEQ ID NO: 3941 - DNA, 495 bp, Artificial Sequence
  Oligonucleotide
gccttgccagcccgctcaggatggcttagagtgtcttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttagagtgtcgtcgacatcagccccagcattttggtgatgggactcgactctccatcctaggtaagttgcagaatcagggtggtatggccattgtcccttgaaggcagagttctctgatggcttagagtgtcctgatggcgcgagggaggc

SEQ ID NO: 3942 - DNA, 495 bp, Artificial Sequence
  Oligonucleotide
gccttgccagcccgctcaggatggcttgttccgaattcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgttccgaagtcgacataattcacccctccactttgggaacgggaccaggctcactgtgacaggtatgggggctccactcttgactcgggggtgcctgggtttgactgcaatgatgatggcttgttccgaactgatggcgcgagggaggc

SEQ ID NO: 3943 - DNA, 495 bp, Artificial Sequence
  Oligonucleotide
gccttgccagcccgctcaggatggcttcgttacttttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttcgttacttgtcgacacaatgagcagttcttcgggccagggacacggctcaccgtgctaggtaagaagggggctccaggtgggagagagggtgagcagcccagcctgcacgacccgatggcttcgttacttctgatggcgcgagggaggc

SEQ ID NO: 3944 - DNA, 495 bp, Artificial Sequence
  Oligonucleotide
gccttgccagcccgctcaggatggctttaggagacttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggctttaggagacgtcgacaccggggagctgttttttggagaaggctctaggctgaccgtactgggtaaggaggcggttggggctccggagagctccgagagggcgggatgggcagagggatggctttaggagacctgatggcgcgagggaggc

SEQ ID NO: 3945 - DNA, 495 bp, Artificial Sequence
  Oligonucleotide
gccttgccagcccgctcaggatggcttgtgtctacttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgtgtctacgtcgacagatacgcagtattttggcccaggcacccggctgacagtgctcggtaagcgggggctcccgctgaagccccggaactggggagggggcgccccgggacgcgatggcttgtgtctacctgatggcgcgagggaggc

SEQ ID NO: 3946 - DNA, 495 bp, Artificial Sequence
  Oligonucleotide
gccttgccagcccgctcaggatggcttgtacagtgttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttgtacagtggtcgacaaaacattcagtacttcggcgccgggacccggctctcagtgctgggtaagctggggccgccgggggaccggggacgagactgcgctcgggtttttgtgcggatggcttgtacagtgctgatggcgcgagggaggc

SEQ ID NO: 3947 - DNA, 495 bp, Artificial Sequence
  Oligonucleotide
gccttgccagcccgctcaggatggcttggatcatcttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttggatcatcgtcgacgagacccagtacttcgggccaggcacgcggctcctggtgctcggtgagcgcgggctgctggggcgcgggcgcgggcggcttgggtctggtttttgcgggggatggcttggatcatcctgatggcgcgagggaggc

SEQ ID NO: 3948 - DNA, 495 bp, Artificial Sequence
  Oligonucleotide
gccttgccagcccgctcaggatggctttattggcgttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggctttattggcggtcgacgggccaacgtcctgactttcggggccggcagcaggctgaccgtgctgggtgagttttcgcgggaccacccgggcggcgggattcaggtggaaggcggcgggatggctttattggcgctgatggcgcgagggaggc

SEQ ID NO: 3949 - DNA, 495 bp, Artificial Sequence
  Oligonucleotide
gccttgccagcccgctcaggatggcttaggcttgattcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtgagatggcttaggcttgagtcgacacgagcagtacttcgggccgggcaccaggctcacggtcacaggtgagattcgggcgtctccccaccttccagcccctcggtccccggagtcggagggtgggatggcttaggcttgactgatggcgcgagggaggc

SEQ ID NO: 3950 - DNA, 495 bp, Artificial Sequence
  Oligonucleotide
gccttgccagcccgctcagctgcaatcgacactctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgacactctgtcgacactgaagctttctttggacaaggcaccagactcacagttgtaggtaagacatttttcaggttcttttgcagatccgtcacagggaaaagtgggtccacagctgcaatcgacactctctgatggcgcgagggaggc

SEQ ID NO: 3951 - DNA, 495 bp, Artificial Sequence
  Oligonucleotide
gccttgccagcccgctcagctgcaatcttcggaacgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcttcggaacgtcgactatggctacaccttcggttcggggaccaggttaaccgttgtaggtaaggctgggggtctctaggaggggtgcgatgagggaggactctgtcctgggaaatctgcaatcttcggaacctgatggcgcgagggaggc

SEQ ID NO: 3952 - DNA, 495 bp, Artificial Sequence
  Oligonucleotide
gccttgccagcccgctcagctgcaatcaagtaacggtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcaagtaacggtcgacgaaacaccatatattttggagagggaagttggctcactgttgtaggtgagtaagtcaaggctggacagctgggaacttgcaaaaaggggctggaatccagctgcaatcaagtaacgctgatggcgcgagggaggc

SEQ ID NO: 3953 - DNA, 495 bp, Artificial Sequence
  Oligonucleotide
gccttgccagcccgctcagctgcaatcgtctcctagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgtctcctagtcgacaatgaaaaactgttttttggcagtggaacccagctctctgtcttgggtatgtaaaagacttctttcgggatagtgtatcataaggtcggagttccaggagctgcaatcgtctcctactgatggcgcgagggaggc

SEQ ID NO: 3954 - DNA, 495 bp, Artificial Sequence
  Oligonucleotide
gccttgccagcccgctcagctgcaatcagagtgtcgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcagagtgtcgtcgacatcagccccagcattttggtgatgggactcgactctccatcctaggtaagttgcagaatcagggtggtatggccattgtcccttgaaggcagagttctctctgcaatcagagtgtcctgatggcgcgagggaggc

SEQ ID NO: 3955 - DNA, 495 bp, Artificial Sequence
  Oligonucleotide
gccttgccagcccgctcagctgcaatcgttccgaagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgttccgaagtcgacataattcacccctccactttgggaacgggaccaggctcactgtgacaggtatgggggctccactcttgactcgggggtgcctgggtttgactgcaatgatctgcaatcgttccgaactgatggcgcgagggaggc

SEQ ID NO: 3956 - DNA, 495 bp, Artificial Sequence
  Oligonucleotide
gccttgccagcccgctcagctgcaatccgttacttgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatccgttacttgtcgacacaatgagcagttcttcgggccagggacacggctcaccgtgctaggtaagaagggggctccaggtgggagagagggtgagcagcccagcctgcacgacccctgcaatccgttacttctgatggcgcgagggaggc

SEQ ID NO: 3957 - DNA, 495 bp, Artificial Sequence
  Oligonucleotide
gccttgccagcccgctcagctgcaatctaggagacgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatctaggagacgtcgacaccggggagctgttttttggagaaggctctaggctgaccgtactgggtaaggaggcggttggggctccggagagctccgagagggcgggatgggcagaggctgcaatctaggagacctgatggcgcgagggaggc

SEQ ID NO: 3958 - DNA, 495 bp, Artificial Sequence
  Oligonucleotide
gccttgccagcccgctcagctgcaatcgtgtctacgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgtgtctacgtcgacagatacgcagtattttggcccaggcacccggctgacagtgctcggtaagcgggggctcccgctgaagccccggaactggggagggggcgccccgggacgcctgcaatcgtgtctacctgatggcgcgagggaggc

SEQ ID NO: 3959 - DNA, 495 bp, Artificial Sequence
  Oligonucleotide
gccttgccagcccgctcagctgcaatcgtacagtggtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcgtacagtggtcgacaaaacattcagtacttcggcgccgggacccggctctcagtgctgggtaagctggggccgccgggggaccggggacgagactgcgctcgggtttttgtgcgctgcaatcgtacagtgctgatggcgcgagggaggc

SEQ ID NO: 3960 - DNA, 495 bp, Artificial Sequence
  Oligonucleotide
gccttgccagcccgctcagctgcaatcggatcatcgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcggatcatcgtcgacgagacccagtacttcgggccaggcacgcggctcctggtgctcggtgagcgcgggctgctggggcgcgggcgcgggcggcttgggtctggtttttgcggggctgcaatcggatcatcctgatggcgcgagggaggc

SEQ ID NO: 3961 - DNA, 495 bp, Artificial Sequence
  Oligonucleotide
gccttgccagcccgctcagctgcaatctattggcggtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatctattggcggtcgacgggccaacgtcctgactttcggggccggcagcaggctgaccgtgctgggtgagttttcgcgggaccacccgggcggcgggattcaggtggaaggcggcggctgcaatctattggcgctgatggcgcgagggaggc

SEQ ID NO: 3962 - DNA, 495 bp, Artificial Sequence
  Oligonucleotide
gccttgccagcccgctcagctgcaatcaggcttgagtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtgactgcaatcaggcttgagtcgacacgagcagtacttcgggccgggcaccaggctcacggtcacaggtgagattcgggcgtctccccaccttccagcccctcggtccccggagtcggagggtggctgcaatcaggcttgactgatggcgcgagggaggc

SEQ ID NO: 3963 - DNA, 495 bp, Artificial Sequence
  Oligonucleotide
gccttgccagcccgctcaggtcatagtgacactctactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgacactctgtcgacactgaagctttctttggacaaggcaccagactcacagttgtaggtaagacatttttcaggttcttttgcagatccgtcacagggaaaagtgggtccacaggtcatagtgacactctctgatggcgcgagggaggc

SEQ ID NO: 3964 - DNA, 495 bp, Artificial Sequence
  Oligonucleotide
gccttgccagcccgctcaggtcatagtttcggaacactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtttcggaacgtcgactatggctacaccttcggttcggggaccaggttaaccgttgtaggtaaggctgggggtctctaggaggggtgcgatgagggaggactctgtcctgggaaatgtcatagtttcggaacctgatggcgcgagggaggc

SEQ ID NO: 3965 - DNA, 495 bp, Artificial Sequence
  Oligonucleotide
gccttgccagcccgctcaggtcatagtaagtaacgactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtaagtaacggtcgacgaaacaccatatattttggagagggaagttggctcactgttgtaggtgagtaagtcaaggctggacagctgggaacttgcaaaaaggggctggaatccaggtcatagtaagtaacgctgatggcgcgagggaggc

SEQ ID NO: 3966 - DNA, 495 bp, Artificial Sequence
  Oligonucleotide
gccttgccagcccgctcaggtcatagtgtctcctaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgtctcctagtcgacaatgaaaaactgttttttggcagtggaacccagctctctgtcttgggtatgtaaaagacttctttcgggatagtgtatcataaggtcggagttccaggaggtcatagtgtctcctactgatggcgcgagggaggc

SEQ ID NO: 3967 - DNA, 495 bp, Artificial Sequence
  Oligonucleotide
gccttgccagcccgctcaggtcatagtagagtgtcactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtagagtgtcgtcgacatcagccccagcattttggtgatgggactcgactctccatcctaggtaagttgcagaatcagggtggtatggccattgtcccttgaaggcagagttctctgtcatagtagagtgtcctgatggcgcgagggaggc

SEQ ID NO: 3968 - DNA, 495 bp, Artificial Sequence
  Oligonucleotide
gccttgccagcccgctcaggtcatagtgttccgaaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgttccgaagtcgacataattcacccctccactttgggaacgggaccaggctcactgtgacaggtatgggggctccactcttgactcgggggtgcctgggtttgactgcaatgatgtcatagtgttccgaactgatggcgcgagggaggc

SEQ ID NO: 3969 - DNA, 495 bp, Artificial Sequence
  Oligonucleotide
gccttgccagcccgctcaggtcatagtcgttacttactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtcgttacttgtcgacacaatgagcagttcttcgggccagggacacggctcaccgtgctaggtaagaagggggctccaggtgggagagagggtgagcagcccagcctgcacgacccgtcatagtcgttacttctgatggcgcgagggaggc

SEQ ID NO: 3970 - DNA, 495 bp, Artificial Sequence
  Oligonucleotide
gccttgccagcccgctcaggtcatagttaggagacactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagttaggagacgtcgacaccggggagctgttttttggagaaggctctaggctgaccgtactgggtaaggaggcggttggggctccggagagctccgagagggcgggatgggcagagggtcatagttaggagacctgatggcgcgagggaggc

SEQ ID NO: 3971 - DNA, 495 bp, Artificial Sequence
  Oligonucleotide
gccttgccagcccgctcaggtcatagtgtgtctacactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgtgtctacgtcgacagatacgcagtattttggcccaggcacccggctgacagtgctcggtaagcgggggctcccgctgaagccccggaactggggagggggcgccccgggacgcgtcatagtgtgtctacctgatggcgcgagggaggc

SEQ ID NO: 3972 - DNA, 495 bp, Artificial Sequence
  Oligonucleotide
gccttgccagcccgctcaggtcatagtgtacagtgactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtgtacagtggtcgacaaaacattcagtacttcggcgccgggacccggctctcagtgctgggtaagctggggccgccgggggaccggggacgagactgcgctcgggtttttgtgcggtcatagtgtacagtgctgatggcgcgagggaggc

SEQ ID NO: 3973 - DNA, 495 bp, Artificial Sequence
  Oligonucleotide
gccttgccagcccgctcaggtcatagtggatcatcactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtggatcatcgtcgacgagacccagtacttcgggccaggcacgcggctcctggtgctcggtgagcgcgggctgctggggcgcgggcgcgggcggcttgggtctggtttttgcgggggtcatagtggatcatcctgatggcgcgagggaggc

SEQ ID NO: 3974 - DNA, 495 bp, Artificial Sequence
  Oligonucleotide
gccttgccagcccgctcaggtcatagttattggcgactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagttattggcggtcgacgggccaacgtcctgactttcggggccggcagcaggctgaccgtgctgggtgagttttcgcgggaccacccgggcggcgggattcaggtggaaggcggcgggtcatagttattggcgctgatggcgcgagggaggc

SEQ ID NO: 3975 - DNA, 495 bp, Artificial Sequence
  Oligonucleotide
gccttgccagcccgctcaggtcatagtaggcttgaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgagtcatagtaggcttgagtcgacacgagcagtacttcgggccgggcaccaggctcacggtcacaggtgagattcgggcgtctccccaccttccagcccctcggtccccggagtcggagggtgggtcatagtaggcttgactgatggcgcgagggaggc

SEQ ID NO: 3976 - DNA, 495 bp, Artificial Sequence
  Oligonucleotide
gccttgccagcccgctcagcacatggagacactcttatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagacactctgtcgacactgaagctttctttggacaaggcaccagactcacagttgtaggtaagacatttttcaggttcttttgcagatccgtcacagggaaaagtgggtccacagcacatggagacactctctgatggcgcgagggaggc

SEQ ID NO: 3977 - DNA, 495 bp, Artificial Sequence
  Oligonucleotide
gccttgccagcccgctcagcacatggattcggaactatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggattcggaacgtcgactatggctacaccttcggttcggggaccaggttaaccgttgtaggtaaggctgggggtctctaggaggggtgcgatgagggaggactctgtcctgggaaatcacatggattcggaacctgatggcgcgagggaggc

SEQ ID NO: 3978 - DNA, 495 bp, Artificial Sequence
  Oligonucleotide
gccttgccagcccgctcagcacatggaaagtaacgtatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaaagtaacggtcgacgaaacaccatatattttggagagggaagttggctcactgttgtaggtgagtaagtcaaggctggacagctgggaacttgcaaaaaggggctggaatccagcacatggaaagtaacgctgatggcgcgagggaggc

SEQ ID NO: 3979 - DNA, 495 bp, Artificial Sequence
  Oligonucleotide
gccttgccagcccgctcagcacatggagtctcctatatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagtctcctagtcgacaatgaaaaactgttttttggcagtggaacccagctctctgtcttgggtatgtaaaagacttctttcgggatagtgtatcataaggtcggagttccaggagcacatggagtctcctactgatggcgcgagggaggc

SEQ ID NO: 3980 - DNA, 495 bp, Artificial Sequence
  Oligonucleotide
gccttgccagcccgctcagcacatggaagagtgtctatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaagagtgtcgtcgacatcagccccagcattttggtgatgggactcgactctccatcctaggtaagttgcagaatcagggtggtatggccattgtcccttgaaggcagagttctctcacatggaagagtgtcctgatggcgcgagggaggc

SEQ ID NO: 3981 - DNA, 495 bp, Artificial Sequence
  Oligonucleotide
gccttgccagcccgctcagcacatggagttccgaatatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagttccgaagtcgacataattcacccctccactttgggaacgggaccaggctcactgtgacaggtatgggggctccactcttgactcgggggtgcctgggtttgactgcaatgatcacatggagttccgaactgatggcgcgagggaggc

SEQ ID NO: 3982 - DNA, 495 bp, Artificial Sequence
  Oligonucleotide
gccttgccagcccgctcagcacatggacgttactttatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggacgttacttgtcgacacaatgagcagttcttcgggccagggacacggctcaccgtgctaggtaagaagggggctccaggtgggagagagggtgagcagcccagcctgcacgaccccacatggacgttacttctgatggcgcgagggaggc

SEQ ID NO: 3983 - DNA, 495 bp, Artificial Sequence
  Oligonucleotide
gccttgccagcccgctcagcacatggataggagactatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggataggagacgtcgacaccggggagctgttttttggagaaggctctaggctgaccgtactgggtaaggaggcggttggggctccggagagctccgagagggcgggatgggcagaggcacatggataggagacctgatggcgcgagggaggc

SEQ ID NO: 3984 - DNA, 495 bp, Artificial Sequence
  Oligonucleotide
gccttgccagcccgctcagcacatggagtgtctactatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagtgtctacgtcgacagatacgcagtattttggcccaggcacccggctgacagtgctcggtaagcgggggctcccgctgaagccccggaactggggagggggcgccccgggacgccacatggagtgtctacctgatggcgcgagggaggc

SEQ ID NO: 3985 - DNA, 495 bp, Artificial Sequence
  Oligonucleotide
gccttgccagcccgctcagcacatggagtacagtgtatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggagtacagtggtcgacaaaacattcagtacttcggcgccgggacccggctctcagtgctgggtaagctggggccgccgggggaccggggacgagactgcgctcgggtttttgtgcgcacatggagtacagtgctgatggcgcgagggaggc

SEQ ID NO: 3986 - DNA, 495 bp, Artificial Sequence
  Oligonucleotide
gccttgccagcccgctcagcacatggaggatcatctatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaggatcatcgtcgacgagacccagtacttcgggccaggcacgcggctcctggtgctcggtgagcgcgggctgctggggcgcgggcgcgggcggcttgggtctggtttttgcggggcacatggaggatcatcctgatggcgcgagggaggc

SEQ ID NO: 3987 - DNA, 495 bp, Artificial Sequence
  Oligonucleotide
gccttgccagcccgctcagcacatggatattggcgtatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggatattggcggtcgacgggccaacgtcctgactttcggggccggcagcaggctgaccgtgctgggtgagttttcgcgggaccacccgggcggcgggattcaggtggaaggcggcggcacatggatattggcgctgatggcgcgagggaggc

SEQ ID NO: 3988 - DNA, 495 bp, Artificial Sequence
  Oligonucleotide
gccttgccagcccgctcagcacatggaaggcttgatatctttcccacaggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgtgacacatggaaggcttgagtcgacacgagcagtacttcgggccgggcaccaggctcacggtcacaggtgagattcgggcgtctccccaccttccagcccctcggtccccggagtcggagggtggcacatggaaggcttgactgatggcgcgagggaggc

SEQ ID NO: 3989 - DNA, 495 bp, Artificial Sequence
  Oligonucleotide
gccttgccagcccgctcagttgaccatgacactcttctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgacactctgtcgacactgaagctttctttggacaaggcaccagactcacagttgtaggtaagacatttttcaggttcttttgcagatccgtcacagggaaaagtgggtccacagttgaccatgacactctctgatggcgcgagggaggc

SEQ ID NO: 3990 - DNA, 495 bp, Artificial Sequence
  Oligonucleotide
gccttgccagcccgctcagttgaccatttcggaactctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatttcggaacgtcgactatggctacaccttcggttcggggaccaggttaaccgttgtaggtaaggctgggggtctctaggaggggtgcgatgagggaggactctgtcctgggaaatttgaccatttcggaacctgatggcgcgagggaggc

SEQ ID NO: 3991 - DNA, 495 bp, Artificial Sequence
  Oligonucleotide
gccttgccagcccgctcagttgaccataagtaacgtctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccataagtaacggtcgacgaaacaccatatattttggagagggaagttggctcactgttgtaggtgagtaagtcaaggctggacagctgggaacttgcaaaaaggggctggaatccagttgaccataagtaacgctgatggcgcgagggaggc

SEQ ID NO: 3992 - DNA, 495 bp, Artificial Sequence
  Oligonucleotide
gccttgccagcccgctcagttgaccatgtctcctatctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgtctcctagtcgacaatgaaaaactgttttttggcagtggaacccagctctctgtcttgggtatgtaaaagacttctttcgggatagtgtatcataaggtcggagttccaggagttgaccatgtctcctactgatggcgcgagggaggc

SEQ ID NO: 3993 - DNA, 495 bp, Artificial Sequence
  Oligonucleotide
gccttgccagcccgctcagttgaccatagagtgtctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatagagtgtcgtcgacatcagccccagcattttggtgatgggactcgactctccatcctaggtaagttgcagaatcagggtggtatggccattgtcccttgaaggcagagttctctttgaccatagagtgtcctgatggcgcgagggaggc

SEQ ID NO: 3994 - DNA, 495 bp, Artificial Sequence
  Oligonucleotide
gccttgccagcccgctcagttgaccatgttccgaatctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgttccgaagtcgacataattcacccctccactttgggaacgggaccaggctcactgtgacaggtatgggggctccactcttgactcgggggtgcctgggtttgactgcaatgatttgaccatgttccgaactgatggcgcgagggaggc

SEQ ID NO: 3995 - DNA, 495 bp, Artificial Sequence
  Oligonucleotide
gccttgccagcccgctcagttgaccatcgttactttctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatcgttacttgtcgacacaatgagcagttcttcgggccagggacacggctcaccgtgctaggtaagaagggggctccaggtgggagagagggtgagcagcccagcctgcacgacccttgaccatcgttacttctgatggcgcgagggaggc

SEQ ID NO: 3996 - DNA, 495 bp, Artificial Sequence
  Oligonucleotide
gccttgccagcccgctcagttgaccattaggagactctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccattaggagacgtcgacaccggggagctgttttttggagaaggctctaggctgaccgtactgggtaaggaggcggttggggctccggagagctccgagagggcgggatgggcagaggttgaccattaggagacctgatggcgcgagggaggc

SEQ ID NO: 3997 - DNA, 495 bp, Artificial Sequence
  Oligonucleotide
gccttgccagcccgctcagttgaccatgtgtctactctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgtgtctacgtcgacagatacgcagtattttggcccaggcacccggctgacagtgctcggtaagcgggggctcccgctgaagccccggaactggggagggggcgccccgggacgcttgaccatgtgtctacctgatggcgcgagggaggc

SEQ ID NO: 3998 - DNA, 495 bp, Artificial Sequence
  Oligonucleotide
gccttgccagcccgctcagttgaccatgtacagtgtctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatgtacagtggtcgacaaaacattcagtacttcggcgccgggacccggctctcagtgctgggtaagctggggccgccgggggaccggggacgagactgcgctcgggtttttgtgcgttgaccatgtacagtgctgatggcgcgagggaggc

SEQ ID NO: 3999 - DNA, 495 bp, Artificial Sequence
  Oligonucleotide
gccttgccagcccgctcagttgaccatggatcatctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccatggatcatcgtcgacgagacccagtacttcgggccaggcacgcggctcctggtgctcggtgagcgcgggctgctggggcgcgggcgcgggcggcttgggtctggtttttgcggggttgaccatggatcatcctgatggcgcgagggaggc

SEQ ID NO: 4000 - DNA, 495 bp, Artificial Sequence
  Oligonucleotide
gccttgccagcccgctcagttgaccattattggcgtctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccattattggcggtcgacgggccaacgtcctgactttcggggccggcagcaggctgaccgtgctgggtgagttttcgcgggaccacccgggcggcgggattcaggtggaaggcggcggttgaccattattggcgctgatggcgcgagggaggc

SEQ ID NO: 4001 - DNA, 495 bp, Artificial Sequence
  Oligonucleotide
gccttgccagcccgctcagttgaccataggcttgatctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtgattgaccataggcttgagtcgacacgagcagtacttcgggccgggcaccaggctcacggtcacaggtgagattcgggcgtctccccaccttccagcccctcggtccccggagtcggagggtggttgaccataggcttgactgatggcgcgagggaggc

SEQ ID NO: 4002 - DNA, 495 bp, Artificial Sequence
  Oligonucleotide
gccttgccagcccgctcaggtgacttggacactctcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggacactctgtcgacactgaagctttctttggacaaggcaccagactcacagttgtaggtaagacatttttcaggttcttttgcagatccgtcacagggaaaagtgggtccacaggtgacttggacactctctgatggcgcgagggaggc

SEQ ID NO: 4003 - DNA, 495 bp, Artificial Sequence
  Oligonucleotide
gccttgccagcccgctcaggtgacttgttcggaaccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgttcggaacgtcgactatggctacaccttcggttcggggaccaggttaaccgttgtaggtaaggctgggggtctctaggaggggtgcgatgagggaggactctgtcctgggaaatgtgacttgttcggaacctgatggcgcgagggaggc

SEQ ID NO: 4004 - DNA, 495 bp, Artificial Sequence
  Oligonucleotide
gccttgccagcccgctcaggtgacttgaagtaacgcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgaagtaacggtcgacgaaacaccatatattttggagagggaagttggctcactgttgtaggtgagtaagtcaaggctggacagctgggaacttgcaaaaaggggctggaatccaggtgacttgaagtaacgctgatggcgcgagggaggc

SEQ ID NO: 4005 - DNA, 495 bp, Artificial Sequence
  Oligonucleotide
gccttgccagcccgctcaggtgacttggtctcctacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggtctcctagtcgacaatgaaaaactgttttttggcagtggaacccagctctctgtcttgggtatgtaaaagacttctttcgggatagtgtatcataaggtcggagttccaggaggtgacttggtctcctactgatggcgcgagggaggc

SEQ ID NO: 4006 - DNA, 495 bp, Artificial Sequence
  Oligonucleotide
gccttgccagcccgctcaggtgacttgagagtgtccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgagagtgtcgtcgacatcagccccagcattttggtgatgggactcgactctccatcctaggtaagttgcagaatcagggtggtatggccattgtcccttgaaggcagagttctctgtgacttgagagtgtcctgatggcgcgagggaggc

SEQ ID NO: 4007 - DNA, 495 bp, Artificial Sequence
  Oligonucleotide
gccttgccagcccgctcaggtgacttggttccgaacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggttccgaagtcgacataattcacccctccactttgggaacgggaccaggctcactgtgacaggtatgggggctccactcttgactcgggggtgcctgggtttgactgcaatgatgtgacttggttccgaactgatggcgcgagggaggc

SEQ ID NO: 4008 - DNA, 495 bp, Artificial Sequence
  Oligonucleotide
gccttgccagcccgctcaggtgacttgcgttacttcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgcgttacttgtcgacacaatgagcagttcttcgggccagggacacggctcaccgtgctaggtaagaagggggctccaggtgggagagagggtgagcagcccagcctgcacgacccgtgacttgcgttacttctgatggcgcgagggaggc

SEQ ID NO: 4009 - DNA, 495 bp, Artificial Sequence
  Oligonucleotide
gccttgccagcccgctcaggtgacttgtaggagaccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgtaggagacgtcgacaccggggagctgttttttggagaaggctctaggctgaccgtactgggtaaggaggcggttggggctccggagagctccgagagggcgggatgggcagagggtgacttgtaggagacctgatggcgcgagggaggc

SEQ ID NO: 4010 - DNA, 495 bp, Artificial Sequence
  Oligonucleotide
gccttgccagcccgctcaggtgacttggtgtctaccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggtgtctacgtcgacagatacgcagtattttggcccaggcacccggctgacagtgctcggtaagcgggggctcccgctgaagccccggaactggggagggggcgccccgggacgcgtgacttggtgtctacctgatggcgcgagggaggc

SEQ ID NO: 4011 - DNA, 495 bp, Artificial Sequence
  Oligonucleotide
gccttgccagcccgctcaggtgacttggtacagtgcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttggtacagtggtcgacaaaacattcagtacttcggcgccgggacccggctctcagtgctgggtaagctggggccgccgggggaccggggacgagactgcgctcgggtttttgtgcggtgacttggtacagtgctgatggcgcgagggaggc

SEQ ID NO: 4012 - DNA, 495 bp, Artificial Sequence
  Oligonucleotide
gccttgccagcccgctcaggtgacttgggatcatccagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgggatcatcgtcgacgagacccagtacttcgggccaggcacgcggctcctggtgctcggtgagcgcgggctgctggggcgcgggcgcgggcggcttgggtctggtttttgcgggggtgacttgggatcatcctgatggcgcgagggaggc

SEQ ID NO: 4013 - DNA, 495 bp, Artificial Sequence
  Oligonucleotide
gccttgccagcccgctcaggtgacttgtattggcgcagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgtattggcggtcgacgggccaacgtcctgactttcggggccggcagcaggctgaccgtgctgggtgagttttcgcgggaccacccgggcggcgggattcaggtggaaggcggcgggtgacttgtattggcgctgatggcgcgagggaggc

SEQ ID NO: 4014 - DNA, 495 bp, Artificial Sequence
  Oligonucleotide
gccttgccagcccgctcaggtgacttgaggcttgacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgtgagtgacttgaggcttgagtcgacacgagcagtacttcgggccgggcaccaggctcacggtcacaggtgagattcgggcgtctccccaccttccagcccctcggtccccggagtcggagggtgggtgacttgaggcttgactgatggcgcgagggaggc

SEQ ID NO: 4015 - DNA, 495 bp, Artificial Sequence; identical to SEQ ID NO: 1561
  Oligonucleotide

SEQ ID NO: 4016 - DNA, 495 bp, Artificial Sequence; identical to SEQ ID NO: 1562
  Oligonucleotide

SEQ ID NO: 4017 - DNA, 495 bp, Artificial Sequence; identical to SEQ ID NO: 1563
  Oligonucleotide

SEQ ID NO: 4018 - DNA, 495 bp, Artificial Sequence; identical to SEQ ID NO: 1564
  Oligonucleotide

SEQ ID NO: 4019 - DNA, 495 bp, Artificial Sequence; identical to SEQ ID NO: 1565
  Oligonucleotide

SEQ ID NO: 4020 - DNA, 495 bp, Artificial Sequence; identical to SEQ ID NO: 1566
  Oligonucleotide

SEQ ID NO: 4021 - DNA, 495 bp, Artificial Sequence; identical to SEQ ID NO: 1567
  Oligonucleotide

SEQ ID NO: 4022 - DNA, 495 bp, Artificial Sequence; identical to SEQ ID NO: 1568
  Oligonucleotide

SEQ ID NO: 4023 - DNA, 495 bp, Artificial Sequence; identical to SEQ ID NO: 1569
  Oligonucleotide

SEQ ID NO: 4024 - DNA, 495 bp, Artificial Sequence; identical to SEQ ID NO: 1570
  Oligonucleotide

SEQ ID NO: 4025 - DNA, 495 bp, Artificial Sequence; identical to SEQ ID NO: 1571
  Oligonucleotide

SEQ ID NO: 4026 - DNA, 495 bp, Artificial Sequence; identical to SEQ ID NO: 1572
  Oligonucleotide

SEQ ID NO: 4027 - DNA, 495 bp, Artificial Sequence; identical to SEQ ID NO: 1573
  Oligonucleotide

SEQ ID NO: 4028 - DNA, 495 bp, Artificial Sequence; identical to SEQ ID NO: 1574
  Oligonucleotide

SEQ ID NO: 4029 - DNA, 495 bp, Artificial Sequence; identical to SEQ ID NO: 1575
  Oligonucleotide

SEQ ID NO: 4030 - DNA, 495 bp, Artificial Sequence; identical to SEQ ID NO: 1576
  Oligonucleotide

SEQ ID NO: 4031 - DNA, 495 bp, Artificial Sequence; identical to SEQ ID NO: 1577
  Oligonucleotide

SEQ ID NO: 4032 - DNA, 495 bp, Artificial Sequence; identical to SEQ ID NO: 1578
  Oligonucleotide

SEQ ID NO: 4033 - DNA, 495 bp, Artificial Sequence; identical to SEQ ID NO: 1579
  Oligonucleotide

SEQ ID NO: 4034 - DNA, 495 bp, Artificial Sequence; identical to SEQ ID NO: 1580
  Oligonucleotide

SEQ ID NO: 4035 - DNA, 495 bp, Artificial Sequence; identical to SEQ ID NO: 1581
  Oligonucleotide

SEQ ID NO: 4036 - DNA, 495 bp, Artificial Sequence; identical to SEQ ID NO: 1582
  Oligonucleotide

SEQ ID NO: 4037 - DNA, 495 bp, Artificial Sequence; identical to SEQ ID NO: 1583
  Oligonucleotide

SEQ ID NO: 4038 - DNA, 495 bp, Artificial Sequence; identical to SEQ ID NO: 1584
  Oligonucleotide

SEQ ID NO: 4039 - DNA, 495 bp, Artificial Sequence; identical to SEQ ID NO: 1585
  Oligonucleotide

SEQ ID NO: 4040 - DNA, 495 bp, Artificial Sequence; identical to SEQ ID NO: 1586
  Oligonucleotide

SEQ ID NO: 4041 - DNA, 495 bp, Artificial Sequence; identical to SEQ ID NO: 1587
  Oligonucleotide

SEQ ID NO: 4042 - DNA, 495 bp, Artificial Sequence; identical to SEQ ID NO: 1588
  Oligonucleotide

SEQ ID NO: 4043 - DNA, 495 bp, Artificial Sequence; identical to SEQ ID NO: 1589
  Oligonucleotide

SEQ ID NO: 4044 - DNA, 495 bp, Artificial Sequence; identical to SEQ ID NO: 1590
  Oligonucleotide

SEQ ID NO: 4045 - DNA, 495 bp, Artificial Sequence; identical to SEQ ID NO: 1591
  Oligonucleotide

SEQ ID NO: 4046 - DNA, 495 bp, Artificial Sequence; identical to SEQ ID NO: 1592
  Oligonucleotide

SEQ ID NO: 4047 - DNA, 495 bp, Artificial Sequence; identical to SEQ ID NO: 1593
  Oligonucleotide

SEQ ID NO: 4048 - DNA, 495 bp, Artificial Sequence; identical to SEQ ID NO: 1594
  Oligonucleotide

SEQ ID NO: 4049 - DNA, 495 bp, Artificial Sequence; identical to SEQ ID NO: 1595
  Oligonucleotide

SEQ ID NO: 4050 - DNA, 495 bp, Artificial Sequence; identical to SEQ ID NO: 1596
  Oligonucleotide

SEQ ID NO: 4051 - DNA, 495 bp, Artificial Sequence; identical to SEQ ID NO: 1597
  Oligonucleotide

SEQ ID NO: 4052 - DNA, 495 bp, Artificial Sequence; identical to SEQ ID NO: 1598
  Oligonucleotide

SEQ ID NO: 4053 - DNA, 495 bp, Artificial Sequence; identical to SEQ ID NO: 1599
  Oligonucleotide

SEQ ID NO: 4054 - DNA, 495 bp, Artificial Sequence; identical to SEQ ID NO: 1600
  Oligonucleotide

SEQ ID NO: 4055 - DNA, 495 bp, Artificial Sequence; identical to SEQ ID NO: 1601
  Oligonucleotide

SEQ ID NO: 4056 - DNA, 495 bp, Artificial Sequence; identical to SEQ ID NO: 1602
  Oligonucleotide

SEQ ID NO: 4057 - DNA, 495 bp, Artificial Sequence; identical to SEQ ID NO: 1603
  Oligonucleotide

SEQ ID NO: 4058 - DNA, 495 bp, Artificial Sequence; identical to SEQ ID NO: 1604
  Oligonucleotide

SEQ ID NO: 4059 - DNA, 495 bp, Artificial Sequence; identical to SEQ ID NO: 1605
  Oligonucleotide

SEQ ID NO: 4060 - DNA, 495 bp, Artificial Sequence; identical to SEQ ID NO: 1606
  Oligonucleotide

SEQ ID NO: 4061 - DNA, 495 bp, Artificial Sequence; identical to SEQ ID NO: 1607
  Oligonucleotide

SEQ ID NO: 4062 - DNA, 495 bp, Artificial Sequence; identical to SEQ ID NO: 1608
  Oligonucleotide

SEQ ID NO: 4063 - DNA, 495 bp, Artificial Sequence; identical to SEQ ID NO: 1609
  Oligonucleotide

SEQ ID NO: 4064 - DNA, 495 bp, Artificial Sequence; identical to SEQ ID NO: 1610
  Oligonucleotide

SEQ ID NO: 4065 - DNA, 495 bp, Artificial Sequence; identical to SEQ ID NO: 1611
  Oligonucleotide

SEQ ID NO: 4066 - DNA, 495 bp, Artificial Sequence; identical to SEQ ID NO: 1612
  Oligonucleotide

SEQ ID NO: 4067 - DNA, 495 bp, Artificial Sequence; identical to SEQ ID NO: 1613
  Oligonucleotide

SEQ ID NO: 4068 - DNA, 495 bp, Artificial Sequence; identical to SEQ ID NO: 1614
  Oligonucleotide

SEQ ID NO: 4069 - DNA, 495 bp, Artificial Sequence; identical to SEQ ID NO: 1615
  Oligonucleotide

SEQ ID NO: 4070 - DNA, 495 bp, Artificial Sequence; identical to SEQ ID NO: 1616
  Oligonucleotide

SEQ ID NO: 4071 - DNA, 495 bp, Artificial Sequence; identical to SEQ ID NO: 1617
  Oligonucleotide

SEQ ID NO: 4072 - DNA, 495 bp, Artificial Sequence; identical to SEQ ID NO: 1618
  Oligonucleotide

SEQ ID NO: 4073 - DNA, 495 bp, Artificial Sequence; identical to SEQ ID NO: 1619
  Oligonucleotide

SEQ ID NO: 4074 - DNA, 495 bp, Artificial Sequence; identical to SEQ ID NO: 1620
  Oligonucleotide

SEQ ID NO: 4075 - DNA, 495 bp, Artificial Sequence; identical to SEQ ID NO: 1621
  Oligonucleotide

SEQ ID NO: 4076 - DNA, 495 bp, Artificial Sequence; identical to SEQ ID NO: 1622
  Oligonucleotide

SEQ ID NO: 4077 - DNA, 495 bp, Artificial Sequence; identical to SEQ ID NO: 1623
  Oligonucleotide

SEQ ID NO: 4078 - DNA, 495 bp, Artificial Sequence; identical to SEQ ID NO: 1624
  Oligonucleotide

SEQ ID NO: 4079 - DNA, 495 bp, Artificial Sequence; identical to SEQ ID NO: 1625
  Oligonucleotide

SEQ ID NO: 4080 - DNA, 495 bp, Artificial Sequence; identical to SEQ ID NO: 1626
  Oligonucleotide

SEQ ID NO: 4081 - DNA, 495 bp, Artificial Sequence; identical to SEQ ID NO: 1627
  Oligonucleotide

SEQ ID NO: 4082 - DNA, 495 bp, Artificial Sequence; identical to SEQ ID NO: 1628
  Oligonucleotide

SEQ ID NO: 4083 - DNA, 495 bp, Artificial Sequence; identical to SEQ ID NO: 1629
  Oligonucleotide

SEQ ID NO: 4084 - DNA, 495 bp, Artificial Sequence; identical to SEQ ID NO: 1630
  Oligonucleotide

SEQ ID NO: 4085 - DNA, 495 bp, Artificial Sequence; identical to SEQ ID NO: 1805
  Oligonucleotide

SEQ ID NO: 4086 - DNA, 495 bp, Artificial Sequence; identical to SEQ ID NO: 1806
  Oligonucleotide

SEQ ID NO: 4087 - DNA, 495 bp, Artificial Sequence; identical to SEQ ID NO: 1807
  Oligonucleotide

SEQ ID NO: 4088 - DNA, 495 bp, Artificial Sequence; identical to SEQ ID NO: 1808
  Oligonucleotide

SEQ ID NO: 4089 - DNA, 495 bp, Artificial Sequence; identical to SEQ ID NO: 1809
  Oligonucleotide

SEQ ID NO: 4090 - DNA, 495 bp, Artificial Sequence; identical to SEQ ID NO: 1810
  Oligonucleotide

SEQ ID NO: 4091 - DNA, 495 bp, Artificial Sequence; identical to SEQ ID NO: 1811
  Oligonucleotide

SEQ ID NO: 4092 - DNA, 495 bp, Artificial Sequence; identical to SEQ ID NO: 1812
  Oligonucleotide

SEQ ID NO: 4093 - DNA, 495 bp, Artificial Sequence; identical to SEQ ID NO: 1813
  Oligonucleotide

SEQ ID NO: 4094 - DNA, 495 bp, Artificial Sequence; identical to SEQ ID NO: 1814
  Oligonucleotide

SEQ ID NO: 4095 - DNA, 495 bp, Artificial Sequence; identical to SEQ ID NO: 1815
  Oligonucleotide

SEQ ID NO: 4096 - DNA, 495 bp, Artificial Sequence; identical to SEQ ID NO: 1816
  Oligonucleotide

SEQ ID NO: 4097 - DNA, 495 bp, Artificial Sequence; identical to SEQ ID NO: 1817
  Oligonucleotide

SEQ ID NO: 4098 - DNA, 495 bp, Artificial Sequence; identical to SEQ ID NO: 1818
  Oligonucleotide

SEQ ID NO: 4099 - DNA, 495 bp, Artificial Sequence; identical to SEQ ID NO: 1819
  Oligonucleotide

SEQ ID NO: 4100 - DNA, 495 bp, Artificial Sequence; identical to SEQ ID NO: 1820
  Oligonucleotide

SEQ ID NO: 4101 - DNA, 495 bp, Artificial Sequence; identical to SEQ ID NO: 1821
  Oligonucleotide

SEQ ID NO: 4102 - DNA, 495 bp, Artificial Sequence; identical to SEQ ID NO: 1822
  Oligonucleotide

SEQ ID NO: 4103 - DNA, 495 bp, Artificial Sequence; identical to SEQ ID NO: 1823
  Oligonucleotide

SEQ ID NO: 4104 - DNA, 495 bp, Artificial Sequence; identical to SEQ ID NO: 1824
  Oligonucleotide

SEQ ID NO: 4105 - DNA, 495 bp, Artificial Sequence; identical to SEQ ID NO: 1825
  Oligonucleotide

SEQ ID NO: 4106 - DNA, 495 bp, Artificial Sequence; identical to SEQ ID NO: 1826
  Oligonucleotide

SEQ ID NO: 4107 - DNA, 495 bp, Artificial Sequence; identical to SEQ ID NO: 1827
  Oligonucleotide

SEQ ID NO: 4108 - DNA, 495 bp, Artificial Sequence; identical to SEQ ID NO: 1828
  Oligonucleotide

SEQ ID NO: 4109 - DNA, 495 bp, Artificial Sequence; identical to SEQ ID NO: 1829
  Oligonucleotide

SEQ ID NO: 4110 - DNA, 495 bp, Artificial Sequence; identical to SEQ ID NO: 1830
  Oligonucleotide

SEQ ID NO: 4111 - DNA, 495 bp, Artificial Sequence; identical to SEQ ID NO: 1831
  Oligonucleotide

SEQ ID NO: 4112 - DNA, 495 bp, Artificial Sequence; identical to SEQ ID NO: 1832
  Oligonucleotide

SEQ ID NO: 4113 - DNA, 495 bp, Artificial Sequence; identical to SEQ ID NO: 1833
  Oligonucleotide

SEQ ID NO: 4114 - DNA, 495 bp, Artificial Sequence; identical to SEQ ID NO: 1834
  Oligonucleotide

SEQ ID NO: 4115 - DNA, 495 bp, Artificial Sequence; identical to SEQ ID NO: 1835
  Oligonucleotide

SEQ ID NO: 4116 - DNA, 495 bp, Artificial Sequence; identical to SEQ ID NO: 1836
  Oligonucleotide

SEQ ID NO: 4117 - DNA, 495 bp, Artificial Sequence; identical to SEQ ID NO: 1837
  Oligonucleotide

SEQ ID NO: 4118 - DNA, 495 bp, Artificial Sequence; identical to SEQ ID NO: 1838
  Oligonucleotide

SEQ ID NO: 4119 - DNA, 495 bp, Artificial Sequence; identical to SEQ ID NO: 1839
  Oligonucleotide

SEQ ID NO: 4120 - DNA, 495 bp, Artificial Sequence; identical to SEQ ID NO: 1840
  Oligonucleotide

SEQ ID NO: 4121 - DNA, 495 bp, Artificial Sequence; identical to SEQ ID NO: 1841
  Oligonucleotide

SEQ ID NO: 4122 - DNA, 495 bp, Artificial Sequence; identical to SEQ ID NO: 1842
  Oligonucleotide

SEQ ID NO: 4123 - DNA, 495 bp, Artificial Sequence; identical to SEQ ID NO: 1843
  Oligonucleotide

SEQ ID NO: 4124 - DNA, 495 bp, Artificial Sequence; identical to SEQ ID NO: 1844
  Oligonucleotide

SEQ ID NO: 4125 - DNA, 495 bp, Artificial Sequence; identical to SEQ ID NO: 1845
  Oligonucleotide

SEQ ID NO: 4126 - DNA, 495 bp, Artificial Sequence; identical to SEQ ID NO: 1846
  Oligonucleotide

SEQ ID NO: 4127 - DNA, 495 bp, Artificial Sequence; identical to SEQ ID NO: 1847
  Oligonucleotide

SEQ ID NO: 4128 - DNA, 495 bp, Artificial Sequence; identical to SEQ ID NO: 1848
  Oligonucleotide

SEQ ID NO: 4129 - DNA, 495 bp, Artificial Sequence; identical to SEQ ID NO: 1849
  Oligonucleotide

SEQ ID NO: 4130 - DNA, 495 bp, Artificial Sequence; identical to SEQ ID NO: 1850
  Oligonucleotide

SEQ ID NO: 4131 - DNA, 495 bp, Artificial Sequence; identical to SEQ ID NO: 1851
  Oligonucleotide

SEQ ID NO: 4132 - DNA, 495 bp, Artificial Sequence; identical to SEQ ID NO: 1852
  Oligonucleotide

SEQ ID NO: 4133 - DNA, 495 bp, Artificial Sequence; identical to SEQ ID NO: 1853
  Oligonucleotide

SEQ ID NO: 4134 - DNA, 495 bp, Artificial Sequence; identical to SEQ ID NO: 1854
  Oligonucleotide

SEQ ID NO: 4135 - DNA, 495 bp, Artificial Sequence; identical to SEQ ID NO: 1855
  Oligonucleotide

SEQ ID NO: 4136 - DNA, 495 bp, Artificial Sequence; identical to SEQ ID NO: 1856
  Oligonucleotide

SEQ ID NO: 4137 - DNA, 495 bp, Artificial Sequence; identical to SEQ ID NO: 1857
  Oligonucleotide

SEQ ID NO: 4138 - DNA, 495 bp, Artificial Sequence; identical to SEQ ID NO: 1858
  Oligonucleotide

SEQ ID NO: 4139 - DNA, 495 bp, Artificial Sequence; identical to SEQ ID NO: 1859
  Oligonucleotide

SEQ ID NO: 4140 - DNA, 495 bp, Artificial Sequence; identical to SEQ ID NO: 1860
  Oligonucleotide

SEQ ID NO: 4141 - DNA, 495 bp, Artificial Sequence; identical to SEQ ID NO: 1861
  Oligonucleotide

SEQ ID NO: 4142 - DNA, 495 bp, Artificial Sequence; identical to SEQ ID NO: 1862
  Oligonucleotide

SEQ ID NO: 4143 - DNA, 495 bp, Artificial Sequence; identical to SEQ ID NO: 1863
  Oligonucleotide

SEQ ID NO: 4144 - DNA, 495 bp, Artificial Sequence; identical to SEQ ID NO: 1864
  Oligonucleotide

SEQ ID NO: 4145 - DNA, 495 bp, Artificial Sequence; identical to SEQ ID NO: 1865
  Oligonucleotide

SEQ ID NO: 4146 - DNA, 495 bp, Artificial Sequence; identical to SEQ ID NO: 1866
  Oligonucleotide

SEQ ID NO: 4147 - DNA, 495 bp, Artificial Sequence; identical to SEQ ID NO: 1867
  Oligonucleotide

SEQ ID NO: 4148 - DNA, 495 bp, Artificial Sequence; identical to SEQ ID NO: 1868
  Oligonucleotide

SEQ ID NO: 4149 - DNA, 495 bp, Artificial Sequence; identical to SEQ ID NO: 1869
  Oligonucleotide

SEQ ID NO: 4150 - DNA, 495 bp, Artificial Sequence; identical to SEQ ID NO: 1870
  Oligonucleotide

SEQ ID NO: 4151 - DNA, 495 bp, Artificial Sequence; identical to SEQ ID NO: 1871
  Oligonucleotide

SEQ ID NO: 4152 - DNA, 495 bp, Artificial Sequence; identical to SEQ ID NO: 1872
  Oligonucleotide

SEQ ID NO: 4153 - DNA, 495 bp, Artificial Sequence; identical to SEQ ID NO: 1873
  Oligonucleotide

SEQ ID NO: 4154 - DNA, 495 bp, Artificial Sequence; identical to SEQ ID NO: 1874
  Oligonucleotide

SEQ ID NO: 4155 - DNA, 495 bp, Artificial Sequence; identical to SEQ ID NO: 1875
  Oligonucleotide

SEQ ID NO: 4156 - DNA, 495 bp, Artificial Sequence; identical to SEQ ID NO: 1876
  Oligonucleotide

SEQ ID NO: 4157 - DNA, 495 bp, Artificial Sequence; identical to SEQ ID NO: 1877
  Oligonucleotide

SEQ ID NO: 4158 - DNA, 495 bp, Artificial Sequence; identical to SEQ ID NO: 1878
  Oligonucleotide

SEQ ID NO: 4159 - DNA, 495 bp, Artificial Sequence; identical to SEQ ID NO: 1879
  Oligonucleotide

SEQ ID NO: 4160 - DNA, 495 bp, Artificial Sequence; identical to SEQ ID NO: 1880
  Oligonucleotide

SEQ ID NO: 4161 - DNA, 495 bp, Artificial Sequence; identical to SEQ ID NO: 1881
  Oligonucleotide

SEQ ID NO: 4162 - DNA, 495 bp, Artificial Sequence; identical to SEQ ID NO: 1882
  Oligonucleotide

SEQ ID NO: 4163 - DNA, 495 bp, Artificial Sequence; identical to SEQ ID NO: 1883
  Oligonucleotide

SEQ ID NO: 4164 - DNA, 495 bp, Artificial Sequence; identical to SEQ ID NO: 1884
  Oligonucleotide

SEQ ID NO: 4165 - DNA, 495 bp, Artificial Sequence; identical to SEQ ID NO: 1885
  Oligonucleotide

SEQ ID NO: 4166 - DNA, 495 bp, Artificial Sequence; identical to SEQ ID NO: 1886
  Oligonucleotide

SEQ ID NO: 4167 - DNA, 495 bp, Artificial Sequence; identical to SEQ ID NO: 1887
  Oligonucleotide

SEQ ID NO: 4168 - DNA, 495 bp, Artificial Sequence; identical to SEQ ID NO: 1888
  Oligonucleotide

SEQ ID NO: 4169 - DNA, 495 bp, Artificial Sequence; identical to SEQ ID NO: 1889
  Oligonucleotide

SEQ ID NO: 4170 - DNA, 495 bp, Artificial Sequence; identical to SEQ ID NO: 1890
  Oligonucleotide

SEQ ID NO: 4171 - DNA, 495 bp, Artificial Sequence; identical to SEQ ID NO: 1891
  Oligonucleotide

SEQ ID NO: 4172 - DNA, 495 bp, Artificial Sequence; identical to SEQ ID NO: 1892
  Oligonucleotide

SEQ ID NO: 4173 - DNA, 495 bp, Artificial Sequence; identical to SEQ ID NO: 1893
  Oligonucleotide

SEQ ID NO: 4174 - DNA, 495 bp, Artificial Sequence; identical to SEQ ID NO: 1894
  Oligonucleotide

SEQ ID NO: 4175 - DNA, 495 bp, Artificial Sequence; identical to SEQ ID NO: 1895
  Oligonucleotide

SEQ ID NO: 4176 - DNA, 495 bp, Artificial Sequence; identical to SEQ ID NO: 1896
  Oligonucleotide

SEQ ID NO: 4177 - DNA, 495 bp, Artificial Sequence; identical to SEQ ID NO: 1897
  Oligonucleotide

SEQ ID NO: 4178 - DNA, 495 bp, Artificial Sequence; identical to SEQ ID NO: 1898
  Oligonucleotide

SEQ ID NO: 4179 - DNA, 495 bp, Artificial Sequence; identical to SEQ ID NO: 1899
  Oligonucleotide

SEQ ID NO: 4180 - DNA, 495 bp, Artificial Sequence; identical to SEQ ID NO: 1900
  Oligonucleotide

SEQ ID NO: 4181 - DNA, 495 bp, Artificial Sequence; identical to SEQ ID NO: 1901
  Oligonucleotide

SEQ ID NO: 4182 - DNA, 495 bp, Artificial Sequence; identical to SEQ ID NO: 1902
  Oligonucleotide

SEQ ID NO: 4183 - DNA, 495 bp, Artificial Sequence; identical to SEQ ID NO: 1903
  Oligonucleotide

SEQ ID NO: 4184 - DNA, 495 bp, Artificial Sequence; identical to SEQ ID NO: 1904
  Oligonucleotide

SEQ ID NO: 4185 - DNA, 495 bp, Artificial Sequence; identical to SEQ ID NO: 1905
  Oligonucleotide

SEQ ID NO: 4186 - DNA, 495 bp, Artificial Sequence; identical to SEQ ID NO: 1906
  Oligonucleotide

SEQ ID NO: 4187 - DNA, 495 bp, Artificial Sequence; identical to SEQ ID NO: 1907
  Oligonucleotide

SEQ ID NO: 4188 - DNA, 495 bp, Artificial Sequence; identical to SEQ ID NO: 1908
  Oligonucleotide

SEQ ID NO: 4189 - DNA, 495 bp, Artificial Sequence; identical to SEQ ID NO: 1909
  Oligonucleotide

SEQ ID NO: 4190 - DNA, 495 bp, Artificial Sequence; identical to SEQ ID NO: 1910
  Oligonucleotide

SEQ ID NO: 4191 - DNA, 495 bp, Artificial Sequence; identical to SEQ ID NO: 1911
  Oligonucleotide

SEQ ID NO: 4192 - DNA, 495 bp, Artificial Sequence; identical to SEQ ID NO: 1912
  Oligonucleotide

SEQ ID NO: 4193 - DNA, 495 bp, Artificial Sequence; identical to SEQ ID NO: 1913
  Oligonucleotide

SEQ ID NO: 4194 - DNA, 495 bp, Artificial Sequence; identical to SEQ ID NO: 1914
  Oligonucleotide

SEQ ID NO: 4195 - DNA, 495 bp, Artificial Sequence; identical to SEQ ID NO: 1915
  Oligonucleotide

SEQ ID NO: 4196 - DNA, 495 bp, Artificial Sequence; identical to SEQ ID NO: 1916
  Oligonucleotide

SEQ ID NO: 4197 - DNA, 495 bp, Artificial Sequence; identical to SEQ ID NO: 1917
  Oligonucleotide

SEQ ID NO: 4198 - DNA, 495 bp, Artificial Sequence; identical to SEQ ID NO: 1918
  Oligonucleotide

SEQ ID NO: 4199 - DNA, 495 bp, Artificial Sequence; identical to SEQ ID NO: 1919
  Oligonucleotide

SEQ ID NO: 4200 - DNA, 495 bp, Artificial Sequence; identical to SEQ ID NO: 1920
  Oligonucleotide

SEQ ID NO: 4201 - DNA, 495 bp, Artificial Sequence; identical to SEQ ID NO: 1921
  Oligonucleotide

SEQ ID NO: 4202 - DNA, 495 bp, Artificial Sequence; identical to SEQ ID NO: 1922
  Oligonucleotide

SEQ ID NO: 4203 - DNA, 495 bp, Artificial Sequence; identical to SEQ ID NO: 1923
  Oligonucleotide

SEQ ID NO: 4204 - DNA, 495 bp, Artificial Sequence; identical to SEQ ID NO: 1924
  Oligonucleotide

SEQ ID NO: 4205 - DNA, 495 bp, Artificial Sequence; identical to SEQ ID NO: 1925
  Oligonucleotide

SEQ ID NO: 4206 - DNA, 495 bp, Artificial Sequence; identical to SEQ ID NO: 1926
  Oligonucleotide

SEQ ID NO: 4207 - DNA, 448 bp, Artificial Sequence; identical to SEQ ID NO: 1927
  Oligonucleotide

SEQ ID NO: 4208 - DNA, 495 bp, Artificial Sequence; identical to SEQ ID NO: 1928
  Oligonucleotide

SEQ ID NO: 4209 - DNA, 495 bp, Artificial Sequence; identical to SEQ ID NO: 1929
  Oligonucleotide

SEQ ID NO: 4210 - DNA, 495 bp, Artificial Sequence; identical to SEQ ID NO: 1930
  Oligonucleotide

SEQ ID NO: 4211 - DNA, 495 bp, Artificial Sequence; identical to SEQ ID NO: 1931
  Oligonucleotide

SEQ ID NO: 4212 - DNA, 495 bp, Artificial Sequence; identical to SEQ ID NO: 1932
  Oligonucleotide

SEQ ID NO: 4213 - DNA, 495 bp, Artificial Sequence; identical to SEQ ID NO: 1933
  Oligonucleotide

SEQ ID NO: 4214 - DNA, 495 bp, Artificial Sequence; identical to SEQ ID NO: 1934
  Oligonucleotide

SEQ ID NO: 4215 - DNA, 495 bp, Artificial Sequence; identical to SEQ ID NO: 1935
  Oligonucleotide

SEQ ID NO: 4216 - DNA, 495 bp, Artificial Sequence; identical to SEQ ID NO: 1936
  Oligonucleotide

SEQ ID NO: 4217 - DNA, 495 bp, Artificial Sequence; identical to SEQ ID NO: 1937
  Oligonucleotide

SEQ ID NO: 4218 - DNA, 495 bp, Artificial Sequence; identical to SEQ ID NO: 1938
  Oligonucleotide

SEQ ID NO: 4219 - DNA, 495 bp, Artificial Sequence; identical to SEQ ID NO: 1939
  Oligonucleotide

SEQ ID NO: 4220 - DNA, 495 bp, Artificial Sequence; identical to SEQ ID NO: 1940
  Oligonucleotide

SEQ ID NO: 4221 - DNA, 495 bp, Artificial Sequence; identical to SEQ ID NO: 1941
  Oligonucleotide

SEQ ID NO: 4222 - DNA, 495 bp, Artificial Sequence; identical to SEQ ID NO: 1942
  Oligonucleotide

SEQ ID NO: 4223 - DNA, 495 bp, Artificial Sequence; identical to SEQ ID NO: 1943
  Oligonucleotide

SEQ ID NO: 4224 - DNA, 495 bp, Artificial Sequence; identical to SEQ ID NO: 1944
  Oligonucleotide

SEQ ID NO: 4225 - DNA, 495 bp, Artificial Sequence; identical to SEQ ID NO: 1945
  Oligonucleotide

SEQ ID NO: 4226 - DNA, 495 bp, Artificial Sequence; identical to SEQ ID NO: 1946
  Oligonucleotide

SEQ ID NO: 4227 - DNA, 495 bp, Artificial Sequence; identical to SEQ ID NO: 1947
  Oligonucleotide

SEQ ID NO: 4228 - DNA, 495 bp, Artificial Sequence; identical to SEQ ID NO: 1948
  Oligonucleotide

SEQ ID NO: 4229 - DNA, 495 bp, Artificial Sequence; identical to SEQ ID NO: 1949
  Oligonucleotide

SEQ ID NO: 4230 - DNA, 495 bp, Artificial Sequence; identical to SEQ ID NO: 1950
  Oligonucleotide

SEQ ID NO: 4231 - DNA, 495 bp, Artificial Sequence; identical to SEQ ID NO: 1951
  Oligonucleotide

SEQ ID NO: 4232 - DNA, 495 bp, Artificial Sequence; identical to SEQ ID NO: 1952
  Oligonucleotide

SEQ ID NO: 4233 - DNA, 495 bp, Artificial Sequence; identical to SEQ ID NO: 1953
  Oligonucleotide

SEQ ID NO: 4234 - DNA, 495 bp, Artificial Sequence; identical to SEQ ID NO: 1954
  Oligonucleotide

SEQ ID NO: 4235 - DNA, 495 bp, Artificial Sequence; identical to SEQ ID NO: 1955
  Oligonucleotide

SEQ ID NO: 4236 - DNA, 495 bp, Artificial Sequence; identical to SEQ ID NO: 1956
  Oligonucleotide

SEQ ID NO: 4237 - DNA, 495 bp, Artificial Sequence; identical to SEQ ID NO: 1957
  Oligonucleotide

SEQ ID NO: 4238 - DNA, 495 bp, Artificial Sequence; identical to SEQ ID NO: 1958
  Oligonucleotide

SEQ ID NO: 4239 - DNA, 495 bp, Artificial Sequence; identical to SEQ ID NO: 1959
  Oligonucleotide

SEQ ID NO: 4240 - DNA, 495 bp, Artificial Sequence; identical to SEQ ID NO: 1960
  Oligonucleotide

SEQ ID NO: 4241 - DNA, 495 bp, Artificial Sequence; identical to SEQ ID NO: 1961
  Oligonucleotide

SEQ ID NO: 4242 - DNA, 495 bp, Artificial Sequence; identical to SEQ ID NO: 1962
  Oligonucleotide

SEQ ID NO: 4243 - DNA, 495 bp, Artificial Sequence; identical to SEQ ID NO: 1963
  Oligonucleotide

SEQ ID NO: 4244 - DNA, 495 bp, Artificial Sequence; identical to SEQ ID NO: 1964
  Oligonucleotide

SEQ ID NO: 4245 - DNA, 495 bp, Artificial Sequence; identical to SEQ ID NO: 1965
  Oligonucleotide

SEQ ID NO: 4246 - DNA, 495 bp, Artificial Sequence; identical to SEQ ID NO: 1966
  Oligonucleotide

SEQ ID NO: 4247 - DNA, 495 bp, Artificial Sequence; identical to SEQ ID NO: 1967
  Oligonucleotide

SEQ ID NO: 4248 - DNA, 495 bp, Artificial Sequence; identical to SEQ ID NO: 1968
  Oligonucleotide

SEQ ID NO: 4249 - DNA, 495 bp, Artificial Sequence; identical to SEQ ID NO: 1969
  Oligonucleotide

SEQ ID NO: 4250 - DNA, 495 bp, Artificial Sequence; identical to SEQ ID NO: 1970
  Oligonucleotide

SEQ ID NO: 4251 - DNA, 495 bp, Artificial Sequence; identical to SEQ ID NO: 1971
  Oligonucleotide

SEQ ID NO: 4252 - DNA, 495 bp, Artificial Sequence; identical to SEQ ID NO: 1972
  Oligonucleotide

SEQ ID NO: 4253 - DNA, 495 bp, Artificial Sequence; identical to SEQ ID NO: 1973
  Oligonucleotide

SEQ ID NO: 4254 - DNA, 495 bp, Artificial Sequence; identical to SEQ ID NO: 1974
  Oligonucleotide

SEQ ID NO: 4255 - DNA, 495 bp, Artificial Sequence; identical to SEQ ID NO: 1975
  Oligonucleotide

SEQ ID NO: 4256 - DNA, 495 bp, Artificial Sequence; identical to SEQ ID NO: 1976
  Oligonucleotide

SEQ ID NO: 4257 - DNA, 495 bp, Artificial Sequence; identical to SEQ ID NO: 1977
  Oligonucleotide

SEQ ID NO: 4258 - DNA, 495 bp, Artificial Sequence; identical to SEQ ID NO: 1978
  Oligonucleotide

SEQ ID NO: 4259 - DNA, 495 bp, Artificial Sequence; identical to SEQ ID NO: 1979
  Oligonucleotide

SEQ ID NO: 4260 - DNA, 495 bp, Artificial Sequence; identical to SEQ ID NO: 1980
  Oligonucleotide

SEQ ID NO: 4261 - DNA, 495 bp, Artificial Sequence; identical to SEQ ID NO: 1981
  Oligonucleotide

SEQ ID NO: 4262 - DNA, 495 bp, Artificial Sequence; identical to SEQ ID NO: 1982
  Oligonucleotide

SEQ ID NO: 4263 - DNA, 495 bp, Artificial Sequence; identical to SEQ ID NO: 1983
  Oligonucleotide

SEQ ID NO: 4264 - DNA, 495 bp, Artificial Sequence; identical to SEQ ID NO: 1984
  Oligonucleotide

SEQ ID NO: 4265 - DNA, 495 bp, Artificial Sequence; identical to SEQ ID NO: 1985
  Oligonucleotide

SEQ ID NO: 4266 - DNA, 495 bp, Artificial Sequence; identical to SEQ ID NO: 1986
  Oligonucleotide

SEQ ID NO: 4267 - DNA, 495 bp, Artificial Sequence; identical to SEQ ID NO: 1987
  Oligonucleotide

SEQ ID NO: 4268 - DNA, 495 bp, Artificial Sequence; identical to SEQ ID NO: 1988
  Oligonucleotide

SEQ ID NO: 4269 - DNA, 495 bp, Artificial Sequence; identical to SEQ ID NO: 1989
  Oligonucleotide

SEQ ID NO: 4270 - DNA, 495 bp, Artificial Sequence; identical to SEQ ID NO: 1990
  Oligonucleotide

SEQ ID NO: 4271 - DNA, 495 bp, Artificial Sequence; identical to SEQ ID NO: 1991
  Oligonucleotide

SEQ ID NO: 4272 - DNA, 495 bp, Artificial Sequence; identical to SEQ ID NO: 1992
  Oligonucleotide

SEQ ID NO: 4273 - DNA, 495 bp, Artificial Sequence; identical to SEQ ID NO: 1993
  Oligonucleotide

SEQ ID NO: 4274 - DNA, 495 bp, Artificial Sequence; identical to SEQ ID NO: 1994
  Oligonucleotide

SEQ ID NO: 4275 - DNA, 495 bp, Artificial Sequence; identical to SEQ ID NO: 1995
  Oligonucleotide

SEQ ID NO: 4276 - DNA, 495 bp, Artificial Sequence; identical to SEQ ID NO: 1996
  Oligonucleotide

SEQ ID NO: 4277 - DNA, 495 bp, Artificial Sequence; identical to SEQ ID NO: 1997
  Oligonucleotide

SEQ ID NO: 4278 - DNA, 495 bp, Artificial Sequence; identical to SEQ ID NO: 1998
  Oligonucleotide

SEQ ID NO: 4279 - DNA, 495 bp, Artificial Sequence; identical to SEQ ID NO: 1999
  Oligonucleotide

SEQ ID NO: 4280 - DNA, 495 bp, Artificial Sequence; identical to SEQ ID NO: 2000
  Oligonucleotide

SEQ ID NO: 4281 - DNA, 495 bp, Artificial Sequence; identical to SEQ ID NO: 2001
  Oligonucleotide

SEQ ID NO: 4282 - DNA, 495 bp, Artificial Sequence; identical to SEQ ID NO: 2002
  Oligonucleotide

SEQ ID NO: 4283 - DNA, 495 bp, Artificial Sequence; identical to SEQ ID NO: 2003
  Oligonucleotide

SEQ ID NO: 4284 - DNA, 495 bp, Artificial Sequence; identical to SEQ ID NO: 2004
  Oligonucleotide

SEQ ID NO: 4285 - DNA, 495 bp, Artificial Sequence; identical to SEQ ID NO: 2005
  Oligonucleotide

SEQ ID NO: 4286 - DNA, 495 bp, Artificial Sequence; identical to SEQ ID NO: 2006
  Oligonucleotide

SEQ ID NO: 4287 - DNA, 495 bp, Artificial Sequence; identical to SEQ ID NO: 2007
  Oligonucleotide

SEQ ID NO: 4288 - DNA, 495 bp, Artificial Sequence; identical to SEQ ID NO: 2008
  Oligonucleotide

SEQ ID NO: 4289 - DNA, 495 bp, Artificial Sequence; identical to SEQ ID NO: 2009
  Oligonucleotide

SEQ ID NO: 4290 - DNA, 495 bp, Artificial Sequence; identical to SEQ ID NO: 2010
  Oligonucleotide

SEQ ID NO: 4291 - DNA, 495 bp, Artificial Sequence; identical to SEQ ID NO: 2011
  Oligonucleotide

SEQ ID NO: 4292 - DNA, 495 bp, Artificial Sequence; identical to SEQ ID NO: 2012
  Oligonucleotide

SEQ ID NO: 4293 - DNA, 495 bp, Artificial Sequence; identical to SEQ ID NO: 2013
  Oligonucleotide

SEQ ID NO: 4294 - DNA, 495 bp, Artificial Sequence; identical to SEQ ID NO: 2014
  Oligonucleotide

SEQ ID NO: 4295 - DNA, 495 bp, Artificial Sequence; identical to SEQ ID NO: 2015
  Oligonucleotide

SEQ ID NO: 4296 - DNA, 495 bp, Artificial Sequence; identical to SEQ ID NO: 2016
  Oligonucleotide

SEQ ID NO: 4297 - DNA, 495 bp, Artificial Sequence; identical to SEQ ID NO: 2017
  Oligonucleotide

SEQ ID NO: 4298 - DNA, 495 bp, Artificial Sequence; identical to SEQ ID NO: 2018
  Oligonucleotide

SEQ ID NO: 4299 - DNA, 495 bp, Artificial Sequence; identical to SEQ ID NO: 2019
  Oligonucleotide

SEQ ID NO: 4300 - DNA, 495 bp, Artificial Sequence; identical to SEQ ID NO: 2020
  Oligonucleotide

SEQ ID NO: 4301 - DNA, 495 bp, Artificial Sequence; identical to SEQ ID NO: 2021
  Oligonucleotide

SEQ ID NO: 4302 - DNA, 495 bp, Artificial Sequence; identical to SEQ ID NO: 2022
  Oligonucleotide

SEQ ID NO: 4303 - DNA, 495 bp, Artificial Sequence; identical to SEQ ID NO: 2023
  Oligonucleotide

SEQ ID NO: 4304 - DNA, 495 bp, Artificial Sequence; identical to SEQ ID NO: 2024
  Oligonucleotide

SEQ ID NO: 4305 - DNA, 495 bp, Artificial Sequence; identical to SEQ ID NO: 2025
  Oligonucleotide

SEQ ID NO: 4306 - DNA, 495 bp, Artificial Sequence; identical to SEQ ID NO: 2026
  Oligonucleotide

SEQ ID NO: 4307 - DNA, 495 bp, Artificial Sequence; identical to SEQ ID NO: 2027
  Oligonucleotide

SEQ ID NO: 4308 - DNA, 495 bp, Artificial Sequence; identical to SEQ ID NO: 2028
  Oligonucleotide

SEQ ID NO: 4309 - DNA, 495 bp, Artificial Sequence; identical to SEQ ID NO: 2029
  Oligonucleotide

SEQ ID NO: 4310 - DNA, 495 bp, Artificial Sequence; identical to SEQ ID NO: 2030
  Oligonucleotide

SEQ ID NO: 4311 - DNA, 495 bp, Artificial Sequence; identical to SEQ ID NO: 2031
  Oligonucleotide

SEQ ID NO: 4312 - DNA, 495 bp, Artificial Sequence; identical to SEQ ID NO: 2032
  Oligonucleotide

SEQ ID NO: 4313 - DNA, 495 bp, Artificial Sequence; identical to SEQ ID NO: 2033
  Oligonucleotide

SEQ ID NO: 4314 - DNA, 495 bp, Artificial Sequence; identical to SEQ ID NO: 2034
  Oligonucleotide

SEQ ID NO: 4315 - DNA, 495 bp, Artificial Sequence; identical to SEQ ID NO: 2035
  Oligonucleotide

SEQ ID NO: 4316 - DNA, 495 bp, Artificial Sequence; identical to SEQ ID NO: 2036
  Oligonucleotide

SEQ ID NO: 4317 - DNA, 495 bp, Artificial Sequence; identical to SEQ ID NO: 2037
  Oligonucleotide

SEQ ID NO: 4318 - DNA, 495 bp, Artificial Sequence; identical to SEQ ID NO: 2038
  Oligonucleotide

SEQ ID NO: 4319 - DNA, 495 bp, Artificial Sequence; identical to SEQ ID NO: 2039
  Oligonucleotide

SEQ ID NO: 4320 - DNA, 495 bp, Artificial Sequence; identical to SEQ ID NO: 2040
  Oligonucleotide

SEQ ID NO: 4321 - DNA, 495 bp, Artificial Sequence; identical to SEQ ID NO: 2041
  Oligonucleotide

SEQ ID NO: 4322 - DNA, 495 bp, Artificial Sequence; identical to SEQ ID NO: 2042
  Oligonucleotide

SEQ ID NO: 4323 - DNA, 495 bp, Artificial Sequence; identical to SEQ ID NO: 2043
  Oligonucleotide

SEQ ID NO: 4324 - DNA, 495 bp, Artificial Sequence; identical to SEQ ID NO: 2044
  Oligonucleotide

SEQ ID NO: 4325 - DNA, 495 bp, Artificial Sequence; identical to SEQ ID NO: 2045
  Oligonucleotide

SEQ ID NO: 4326 - DNA, 495 bp, Artificial Sequence; identical to SEQ ID NO: 2046
  Oligonucleotide

SEQ ID NO: 4327 - DNA, 495 bp, Artificial Sequence; identical to SEQ ID NO: 2047
  Oligonucleotide

SEQ ID NO: 4328 - DNA, 495 bp, Artificial Sequence; identical to SEQ ID NO: 2048
  Oligonucleotide

SEQ ID NO: 4329 - DNA, 495 bp, Artificial Sequence; identical to SEQ ID NO: 2049
  Oligonucleotide

SEQ ID NO: 4330 - DNA, 495 bp, Artificial Sequence; identical to SEQ ID NO: 2050
  Oligonucleotide

SEQ ID NO: 4331 - DNA, 448 bp, Artificial Sequence; identical to SEQ ID NO: 2051
  Oligonucleotide

SEQ ID NO: 4332 - DNA, 495 bp, Artificial Sequence; identical to SEQ ID NO: 2052
  Oligonucleotide

SEQ ID NO: 4333 - DNA, 495 bp, Artificial Sequence; identical to SEQ ID NO: 2053
  Oligonucleotide

SEQ ID NO: 4334 - DNA, 495 bp, Artificial Sequence; identical to SEQ ID NO: 2054
  Oligonucleotide

SEQ ID NO: 4335 - DNA, 495 bp, Artificial Sequence; identical to SEQ ID NO: 2055
  Oligonucleotide

SEQ ID NO: 4336 - DNA, 495 bp, Artificial Sequence; identical to SEQ ID NO: 2056
  Oligonucleotide

SEQ ID NO: 4337 - DNA, 495 bp, Artificial Sequence; identical to SEQ ID NO: 2057
  Oligonucleotide

SEQ ID NO: 4338 - DNA, 495 bp, Artificial Sequence; identical to SEQ ID NO: 2058
  Oligonucleotide

SEQ ID NO: 4339 - DNA, 495 bp, Artificial Sequence; identical to SEQ ID NO: 2059
  Oligonucleotide

SEQ ID NO: 4340 - DNA, 495 bp, Artificial Sequence; identical to SEQ ID NO: 2060
  Oligonucleotide

SEQ ID NO: 4341 - DNA, 495 bp, Artificial Sequence; identical to SEQ ID NO: 2061
  Oligonucleotide

SEQ ID NO: 4342 - DNA, 495 bp, Artificial Sequence; identical to SEQ ID NO: 2062
  Oligonucleotide

SEQ ID NO: 4343 - DNA, 495 bp, Artificial Sequence; identical to SEQ ID NO: 2063
  Oligonucleotide

SEQ ID NO: 4344 - DNA, 495 bp, Artificial Sequence; identical to SEQ ID NO: 2064
  Oligonucleotide

SEQ ID NO: 4345 - DNA, 495 bp, Artificial Sequence; identical to SEQ ID NO: 2065
  Oligonucleotide

SEQ ID NO: 4346 - DNA, 495 bp, Artificial Sequence; identical to SEQ ID NO: 2066
  Oligonucleotide

SEQ ID NO: 4347 - DNA, 495 bp, Artificial Sequence; identical to SEQ ID NO: 2067
  Oligonucleotide

SEQ ID NO: 4348 - DNA, 495 bp, Artificial Sequence; identical to SEQ ID NO: 2068
  Oligonucleotide

SEQ ID NO: 4349 - DNA, 495 bp, Artificial Sequence; identical to SEQ ID NO: 2069
  Oligonucleotide

SEQ ID NO: 4350 - DNA, 495 bp, Artificial Sequence; identical to SEQ ID NO: 2070
  Oligonucleotide

SEQ ID NO: 4351 - DNA, 495 bp, Artificial Sequence; identical to SEQ ID NO: 2071
  Oligonucleotide

SEQ ID NO: 4352 - DNA, 495 bp, Artificial Sequence; identical to SEQ ID NO: 2072
  Oligonucleotide

SEQ ID NO: 4353 - DNA, 495 bp, Artificial Sequence; identical to SEQ ID NO: 2073
  Oligonucleotide

SEQ ID NO: 4354 - DNA, 495 bp, Artificial Sequence; identical to SEQ ID NO: 2074
  Oligonucleotide

SEQ ID NO: 4355 - DNA, 495 bp, Artificial Sequence; identical to SEQ ID NO: 2075
  Oligonucleotide

SEQ ID NO: 4356 - DNA, 495 bp, Artificial Sequence; identical to SEQ ID NO: 2076
  Oligonucleotide

SEQ ID NO: 4357 - DNA, 495 bp, Artificial Sequence; identical to SEQ ID NO: 2077
  Oligonucleotide

SEQ ID NO: 4358 - DNA, 495 bp, Artificial Sequence; identical to SEQ ID NO: 2078
  Oligonucleotide

SEQ ID NO: 4359 - DNA, 495 bp, Artificial Sequence; identical to SEQ ID NO: 2079
  Oligonucleotide

SEQ ID NO: 4360 - DNA, 495 bp, Artificial Sequence; identical to SEQ ID NO: 2080
  Oligonucleotide

SEQ ID NO: 4361 - DNA, 495 bp, Artificial Sequence; identical to SEQ ID NO: 2081
  Oligonucleotide

SEQ ID NO: 4362 - DNA, 495 bp, Artificial Sequence; identical to SEQ ID NO: 2082
  Oligonucleotide

SEQ ID NO: 4363 - DNA, 495 bp, Artificial Sequence; identical to SEQ ID NO: 2083
  Oligonucleotide

SEQ ID NO: 4364 - DNA, 495 bp, Artificial Sequence; identical to SEQ ID NO: 2084
  Oligonucleotide

SEQ ID NO: 4365 - DNA, 495 bp, Artificial Sequence; identical to SEQ ID NO: 2085
  Oligonucleotide

SEQ ID NO: 4366 - DNA, 495 bp, Artificial Sequence; identical to SEQ ID NO: 2086
  Oligonucleotide

SEQ ID NO: 4367 - DNA, 495 bp, Artificial Sequence; identical to SEQ ID NO: 2087
  Oligonucleotide

SEQ ID NO: 4368 - DNA, 495 bp, Artificial Sequence; identical to SEQ ID NO: 2088
  Oligonucleotide

SEQ ID NO: 4369 - DNA, 495 bp, Artificial Sequence; identical to SEQ ID NO: 2089
  Oligonucleotide

SEQ ID NO: 4370 - DNA, 495 bp, Artificial Sequence; identical to SEQ ID NO: 2090
  Oligonucleotide

SEQ ID NO: 4371 - DNA, 495 bp, Artificial Sequence; identical to SEQ ID NO: 2091
  Oligonucleotide

SEQ ID NO: 4372 - DNA, 495 bp, Artificial Sequence; identical to SEQ ID NO: 2092
  Oligonucleotide

SEQ ID NO: 4373 - DNA, 495 bp, Artificial Sequence; identical to SEQ ID NO: 2093
  Oligonucleotide

SEQ ID NO: 4374 - DNA, 495 bp, Artificial Sequence; identical to SEQ ID NO: 2094
  Oligonucleotide

SEQ ID NO: 4375 - DNA, 495 bp, Artificial Sequence; identical to SEQ ID NO: 2095
  Oligonucleotide

SEQ ID NO: 4376 - DNA, 495 bp, Artificial Sequence; identical to SEQ ID NO: 2096
  Oligonucleotide

SEQ ID NO: 4377 - DNA, 495 bp, Artificial Sequence; identical to SEQ ID NO: 2097
  Oligonucleotide

SEQ ID NO: 4378 - DNA, 495 bp, Artificial Sequence; identical to SEQ ID NO: 2098
  Oligonucleotide

SEQ ID NO: 4379 - DNA, 495 bp, Artificial Sequence; identical to SEQ ID NO: 2099
  Oligonucleotide

SEQ ID NO: 4380 - DNA, 495 bp, Artificial Sequence; identical to SEQ ID NO: 2100
  Oligonucleotide

SEQ ID NO: 4381 - DNA, 495 bp, Artificial Sequence; identical to SEQ ID NO: 2101
  Oligonucleotide

SEQ ID NO: 4382 - DNA, 495 bp, Artificial Sequence; identical to SEQ ID NO: 2102
  Oligonucleotide

SEQ ID NO: 4383 - DNA, 495 bp, Artificial Sequence; identical to SEQ ID NO: 2103
  Oligonucleotide

SEQ ID NO: 4384 - DNA, 495 bp, Artificial Sequence; identical to SEQ ID NO: 2104
  Oligonucleotide

SEQ ID NO: 4385 - DNA, 495 bp, Artificial Sequence; identical to SEQ ID NO: 2105
  Oligonucleotide

SEQ ID NO: 4386 - DNA, 495 bp, Artificial Sequence; identical to SEQ ID NO: 2106
  Oligonucleotide

SEQ ID NO: 4387 - DNA, 495 bp, Artificial Sequence; identical to SEQ ID NO: 2107
  Oligonucleotide

SEQ ID NO: 4388 - DNA, 495 bp, Artificial Sequence; identical to SEQ ID NO: 2108
  Oligonucleotide

SEQ ID NO: 4389 - DNA, 495 bp, Artificial Sequence; identical to SEQ ID NO: 2109
  Oligonucleotide

SEQ ID NO: 4390 - DNA, 495 bp, Artificial Sequence; identical to SEQ ID NO: 2110
  Oligonucleotide

SEQ ID NO: 4391 - DNA, 495 bp, Artificial Sequence; identical to SEQ ID NO: 2111
  Oligonucleotide

SEQ ID NO: 4392 - DNA, 495 bp, Artificial Sequence; identical to SEQ ID NO: 2112
  Oligonucleotide

SEQ ID NO: 4393 - DNA, 495 bp, Artificial Sequence; identical to SEQ ID NO: 2113
  Oligonucleotide

SEQ ID NO: 4394 - DNA, 495 bp, Artificial Sequence; identical to SEQ ID NO: 2114
  Oligonucleotide

SEQ ID NO: 4395 - DNA, 495 bp, Artificial Sequence; identical to SEQ ID NO: 2115
  Oligonucleotide

SEQ ID NO: 4396 - DNA, 495 bp, Artificial Sequence; identical to SEQ ID NO: 2116
  Oligonucleotide

SEQ ID NO: 4397 - DNA, 495 bp, Artificial Sequence; identical to SEQ ID NO: 2117
  Oligonucleotide

SEQ ID NO: 4398 - DNA, 495 bp, Artificial Sequence; identical to SEQ ID NO: 2118
  Oligonucleotide

SEQ ID NO: 4399 - DNA, 495 bp, Artificial Sequence; identical to SEQ ID NO: 2119
  Oligonucleotide

SEQ ID NO: 4400 - DNA, 495 bp, Artificial Sequence; identical to SEQ ID NO: 2120
  Oligonucleotide

SEQ ID NO: 4401 - DNA, 495 bp, Artificial Sequence; identical to SEQ ID NO: 2121
  Oligonucleotide

SEQ ID NO: 4402 - DNA, 495 bp, Artificial Sequence; identical to SEQ ID NO: 2122
  Oligonucleotide

SEQ ID NO: 4403 - DNA, 495 bp, Artificial Sequence; identical to SEQ ID NO: 2123
  Oligonucleotide

SEQ ID NO: 4404 - DNA, 495 bp, Artificial Sequence; identical to SEQ ID NO: 2124
  Oligonucleotide

SEQ ID NO: 4405 - DNA, 495 bp, Artificial Sequence; identical to SEQ ID NO: 2125
  Oligonucleotide

SEQ ID NO: 4406 - DNA, 495 bp, Artificial Sequence; identical to SEQ ID NO: 2126
  Oligonucleotide

SEQ ID NO: 4407 - DNA, 495 bp, Artificial Sequence; identical to SEQ ID NO: 2127
  Oligonucleotide

SEQ ID NO: 4408 - DNA, 495 bp, Artificial Sequence; identical to SEQ ID NO: 2128
  Oligonucleotide

SEQ ID NO: 4409 - DNA, 495 bp, Artificial Sequence; identical to SEQ ID NO: 2129
  Oligonucleotide

SEQ ID NO: 4410 - DNA, 495 bp, Artificial Sequence; identical to SEQ ID NO: 2130
  Oligonucleotide

SEQ ID NO: 4411 - DNA, 495 bp, Artificial Sequence; identical to SEQ ID NO: 2131
  Oligonucleotide

SEQ ID NO: 4412 - DNA, 495 bp, Artificial Sequence; identical to SEQ ID NO: 2132
  Oligonucleotide

SEQ ID NO: 4413 - DNA, 495 bp, Artificial Sequence; identical to SEQ ID NO: 2133
  Oligonucleotide

SEQ ID NO: 4414 - DNA, 495 bp, Artificial Sequence; identical to SEQ ID NO: 2134
  Oligonucleotide

SEQ ID NO: 4415 - DNA, 495 bp, Artificial Sequence; identical to SEQ ID NO: 2135
  Oligonucleotide

SEQ ID NO: 4416 - DNA, 495 bp, Artificial Sequence; identical to SEQ ID NO: 2136
  Oligonucleotide

SEQ ID NO: 4417 - DNA, 495 bp, Artificial Sequence; identical to SEQ ID NO: 2137
  Oligonucleotide

SEQ ID NO: 4418 - DNA, 495 bp, Artificial Sequence; identical to SEQ ID NO: 2138
  Oligonucleotide

SEQ ID NO: 4419 - DNA, 495 bp, Artificial Sequence; identical to SEQ ID NO: 2139
  Oligonucleotide

SEQ ID NO: 4420 - DNA, 495 bp, Artificial Sequence; identical to SEQ ID NO: 2140
  Oligonucleotide

SEQ ID NO: 4421 - DNA, 495 bp, Artificial Sequence; identical to SEQ ID NO: 2141
  Oligonucleotide

SEQ ID NO: 4422 - DNA, 495 bp, Artificial Sequence; identical to SEQ ID NO: 2142
  Oligonucleotide

SEQ ID NO: 4423 - DNA, 495 bp, Artificial Sequence; identical to SEQ ID NO: 2143
  Oligonucleotide

SEQ ID NO: 4424 - DNA, 495 bp, Artificial Sequence; identical to SEQ ID NO: 2144
  Oligonucleotide

SEQ ID NO: 4425 - DNA, 495 bp, Artificial Sequence; identical to SEQ ID NO: 2145
  Oligonucleotide

SEQ ID NO: 4426 - DNA, 495 bp, Artificial Sequence; identical to SEQ ID NO: 2146
  Oligonucleotide

SEQ ID NO: 4427 - DNA, 495 bp, Artificial Sequence; identical to SEQ ID NO: 2147
  Oligonucleotide

SEQ ID NO: 4428 - DNA, 495 bp, Artificial Sequence; identical to SEQ ID NO: 2148
  Oligonucleotide

SEQ ID NO: 4429 - DNA, 495 bp, Artificial Sequence; identical to SEQ ID NO: 2149
  Oligonucleotide

SEQ ID NO: 4430 - DNA, 495 bp, Artificial Sequence; identical to SEQ ID NO: 2150
  Oligonucleotide

SEQ ID NO: 4431 - DNA, 495 bp, Artificial Sequence; identical to SEQ ID NO: 2151
  Oligonucleotide

SEQ ID NO: 4432 - DNA, 495 bp, Artificial Sequence; identical to SEQ ID NO: 2152
  Oligonucleotide

SEQ ID NO: 4433 - DNA, 495 bp, Artificial Sequence; identical to SEQ ID NO: 2153
  Oligonucleotide

SEQ ID NO: 4434 - DNA, 495 bp, Artificial Sequence; identical to SEQ ID NO: 2154
  Oligonucleotide

SEQ ID NO: 4435 - DNA, 495 bp, Artificial Sequence; identical to SEQ ID NO: 2155
  Oligonucleotide

SEQ ID NO: 4436 - DNA, 495 bp, Artificial Sequence; identical to SEQ ID NO: 2156
  Oligonucleotide

SEQ ID NO: 4437 - DNA, 495 bp, Artificial Sequence; identical to SEQ ID NO: 2157
  Oligonucleotide

SEQ ID NO: 4438 - DNA, 495 bp, Artificial Sequence; identical to SEQ ID NO: 2158
  Oligonucleotide

SEQ ID NO: 4439 - DNA, 495 bp, Artificial Sequence; identical to SEQ ID NO: 2159
  Oligonucleotide

SEQ ID NO: 4440 - DNA, 495 bp, Artificial Sequence; identical to SEQ ID NO: 2160
  Oligonucleotide

SEQ ID NO: 4441 - DNA, 495 bp, Artificial Sequence; identical to SEQ ID NO: 2161
  Oligonucleotide

SEQ ID NO: 4442 - DNA, 495 bp, Artificial Sequence; identical to SEQ ID NO: 2162
  Oligonucleotide

SEQ ID NO: 4443 - DNA, 495 bp, Artificial Sequence; identical to SEQ ID NO: 2163
  Oligonucleotide

SEQ ID NO: 4444 - DNA, 495 bp, Artificial Sequence; identical to SEQ ID NO: 2164
  Oligonucleotide

SEQ ID NO: 4445 - DNA, 495 bp, Artificial Sequence; identical to SEQ ID NO: 2165
  Oligonucleotide

SEQ ID NO: 4446 - DNA, 495 bp, Artificial Sequence; identical to SEQ ID NO: 2166
  Oligonucleotide

SEQ ID NO: 4447 - DNA, 495 bp, Artificial Sequence; identical to SEQ ID NO: 2167
  Oligonucleotide

SEQ ID NO: 4448 - DNA, 495 bp, Artificial Sequence; identical to SEQ ID NO: 2168
  Oligonucleotide

SEQ ID NO: 4449 - DNA, 495 bp, Artificial Sequence; identical to SEQ ID NO: 2169
  Oligonucleotide

SEQ ID NO: 4450 - DNA, 495 bp, Artificial Sequence; identical to SEQ ID NO: 2170
  Oligonucleotide

SEQ ID NO: 4451 - DNA, 495 bp, Artificial Sequence; identical to SEQ ID NO: 2171
  Oligonucleotide

SEQ ID NO: 4452 - DNA, 495 bp, Artificial Sequence; identical to SEQ ID NO: 2172
  Oligonucleotide

SEQ ID NO: 4453 - DNA, 495 bp, Artificial Sequence; identical to SEQ ID NO: 2173
  Oligonucleotide

SEQ ID NO: 4454 - DNA, 495 bp, Artificial Sequence; identical to SEQ ID NO: 2174
  Oligonucleotide

SEQ ID NO: 4455 - DNA, 448 bp, Artificial Sequence; identical to SEQ ID NO: 2175
  Oligonucleotide

SEQ ID NO: 4456 - DNA, 495 bp, Artificial Sequence; identical to SEQ ID NO: 2176
  Oligonucleotide

SEQ ID NO: 4457 - DNA, 495 bp, Artificial Sequence; identical to SEQ ID NO: 2177
  Oligonucleotide

SEQ ID NO: 4458 - DNA, 495 bp, Artificial Sequence; identical to SEQ ID NO: 2178
  Oligonucleotide

SEQ ID NO: 4459 - DNA, 495 bp, Artificial Sequence; identical to SEQ ID NO: 2179
  Oligonucleotide

SEQ ID NO: 4460 - DNA, 495 bp, Artificial Sequence; identical to SEQ ID NO: 2180
  Oligonucleotide

SEQ ID NO: 4461 - DNA, 495 bp, Artificial Sequence; identical to SEQ ID NO: 2181
  Oligonucleotide

SEQ ID NO: 4462 - DNA, 495 bp, Artificial Sequence; identical to SEQ ID NO: 2182
  Oligonucleotide

SEQ ID NO: 4463 - DNA, 495 bp, Artificial Sequence; identical to SEQ ID NO: 2183
  Oligonucleotide

SEQ ID NO: 4464 - DNA, 495 bp, Artificial Sequence; identical to SEQ ID NO: 2184
  Oligonucleotide

SEQ ID NO: 4465 - DNA, 495 bp, Artificial Sequence; identical to SEQ ID NO: 2185
  Oligonucleotide

SEQ ID NO: 4466 - DNA, 495 bp, Artificial Sequence; identical to SEQ ID NO: 2186
  Oligonucleotide

SEQ ID NO: 4467 - DNA, 495 bp, Artificial Sequence; identical to SEQ ID NO: 2187
  Oligonucleotide

SEQ ID NO: 4468 - DNA, 495 bp, Artificial Sequence; identical to SEQ ID NO: 2188
  Oligonucleotide

SEQ ID NO: 4469 - DNA, 495 bp, Artificial Sequence; identical to SEQ ID NO: 2189
  Oligonucleotide

SEQ ID NO: 4470 - DNA, 495 bp, Artificial Sequence; identical to SEQ ID NO: 2190
  Oligonucleotide

SEQ ID NO: 4471 - DNA, 495 bp, Artificial Sequence; identical to SEQ ID NO: 2191
  Oligonucleotide

SEQ ID NO: 4472 - DNA, 495 bp, Artificial Sequence; identical to SEQ ID NO: 2192
  Oligonucleotide

SEQ ID NO: 4473 - DNA, 495 bp, Artificial Sequence; identical to SEQ ID NO: 2193
  Oligonucleotide

SEQ ID NO: 4474 - DNA, 495 bp, Artificial Sequence; identical to SEQ ID NO: 2194
  Oligonucleotide

SEQ ID NO: 4475 - DNA, 495 bp, Artificial Sequence; identical to SEQ ID NO: 2195
  Oligonucleotide

SEQ ID NO: 4476 - DNA, 495 bp, Artificial Sequence; identical to SEQ ID NO: 2196
  Oligonucleotide

SEQ ID NO: 4477 - DNA, 495 bp, Artificial Sequence; identical to SEQ ID NO: 2197
  Oligonucleotide

SEQ ID NO: 4478 - DNA, 495 bp, Artificial Sequence; identical to SEQ ID NO: 2198
  Oligonucleotide

SEQ ID NO: 4479 - DNA, 495 bp, Artificial Sequence; identical to SEQ ID NO: 2199
  Oligonucleotide

SEQ ID NO: 4480 - DNA, 495 bp, Artificial Sequence; identical to SEQ ID NO: 2200
  Oligonucleotide

SEQ ID NO: 4481 - DNA, 495 bp, Artificial Sequence; identical to SEQ ID NO: 2201
  Oligonucleotide

SEQ ID NO: 4482 - DNA, 495 bp, Artificial Sequence; identical to SEQ ID NO: 2202
  Oligonucleotide

SEQ ID NO: 4483 - DNA, 495 bp, Artificial Sequence; identical to SEQ ID NO: 2203
  Oligonucleotide

SEQ ID NO: 4484 - DNA, 495 bp, Artificial Sequence; identical to SEQ ID NO: 2204
  Oligonucleotide

SEQ ID NO: 4485 - DNA, 495 bp, Artificial Sequence; identical to SEQ ID NO: 2205
  Oligonucleotide

SEQ ID NO: 4486 - DNA, 495 bp, Artificial Sequence; identical to SEQ ID NO: 2206
  Oligonucleotide

SEQ ID NO: 4487 - DNA, 495 bp, Artificial Sequence; identical to SEQ ID NO: 2207
  Oligonucleotide

SEQ ID NO: 4488 - DNA, 495 bp, Artificial Sequence; identical to SEQ ID NO: 2208
  Oligonucleotide

SEQ ID NO: 4489 - DNA, 495 bp, Artificial Sequence; identical to SEQ ID NO: 2209
  Oligonucleotide

SEQ ID NO: 4490 - DNA, 495 bp, Artificial Sequence; identical to SEQ ID NO: 2210
  Oligonucleotide

SEQ ID NO: 4491 - DNA, 495 bp, Artificial Sequence; identical to SEQ ID NO: 2211
  Oligonucleotide

SEQ ID NO: 4492 - DNA, 495 bp, Artificial Sequence; identical to SEQ ID NO: 2212
  Oligonucleotide

SEQ ID NO: 4493 - DNA, 495 bp, Artificial Sequence; identical to SEQ ID NO: 2213
  Oligonucleotide

SEQ ID NO: 4494 - DNA, 495 bp, Artificial Sequence; identical to SEQ ID NO: 2214
  Oligonucleotide

SEQ ID NO: 4495 - DNA, 495 bp, Artificial Sequence; identical to SEQ ID NO: 2215
  Oligonucleotide

SEQ ID NO: 4496 - DNA, 495 bp, Artificial Sequence; identical to SEQ ID NO: 2216
  Oligonucleotide

SEQ ID NO: 4497 - DNA, 495 bp, Artificial Sequence; identical to SEQ ID NO: 2217
  Oligonucleotide

SEQ ID NO: 4498 - DNA, 495 bp, Artificial Sequence; identical to SEQ ID NO: 2218
  Oligonucleotide

SEQ ID NO: 4499 - DNA, 495 bp, Artificial Sequence; identical to SEQ ID NO: 2219
  Oligonucleotide

SEQ ID NO: 4500 - DNA, 495 bp, Artificial Sequence; identical to SEQ ID NO: 2220
  Oligonucleotide

SEQ ID NO: 4501 - DNA, 495 bp, Artificial Sequence; identical to SEQ ID NO: 2221
  Oligonucleotide

SEQ ID NO: 4502 - DNA, 495 bp, Artificial Sequence; identical to SEQ ID NO: 2222
  Oligonucleotide

SEQ ID NO: 4503 - DNA, 495 bp, Artificial Sequence; identical to SEQ ID NO: 2223
  Oligonucleotide

SEQ ID NO: 4504 - DNA, 495 bp, Artificial Sequence; identical to SEQ ID NO: 2224
  Oligonucleotide

SEQ ID NO: 4505 - DNA, 495 bp, Artificial Sequence; identical to SEQ ID NO: 2225
  Oligonucleotide

SEQ ID NO: 4506 - DNA, 495 bp, Artificial Sequence; identical to SEQ ID NO: 2226
  Oligonucleotide

SEQ ID NO: 4507 - DNA, 495 bp, Artificial Sequence; identical to SEQ ID NO: 2227
  Oligonucleotide

SEQ ID NO: 4508 - DNA, 495 bp, Artificial Sequence; identical to SEQ ID NO: 2228
  Oligonucleotide

SEQ ID NO: 4509 - DNA, 495 bp, Artificial Sequence; identical to SEQ ID NO: 2229
  Oligonucleotide

SEQ ID NO: 4510 - DNA, 495 bp, Artificial Sequence; identical to SEQ ID NO: 2230
  Oligonucleotide

SEQ ID NO: 4511 - DNA, 495 bp, Artificial Sequence; identical to SEQ ID NO: 2231
  Oligonucleotide

SEQ ID NO: 4512 - DNA, 495 bp, Artificial Sequence; identical to SEQ ID NO: 2232
  Oligonucleotide

SEQ ID NO: 4513 - DNA, 495 bp, Artificial Sequence; identical to SEQ ID NO: 2233
  Oligonucleotide

SEQ ID NO: 4514 - DNA, 495 bp, Artificial Sequence; identical to SEQ ID NO: 2234
  Oligonucleotide

SEQ ID NO: 4515 - DNA, 495 bp, Artificial Sequence; identical to SEQ ID NO: 2235
  Oligonucleotide

SEQ ID NO: 4516 - DNA, 495 bp, Artificial Sequence; identical to SEQ ID NO: 2236
  Oligonucleotide

SEQ ID NO: 4517 - DNA, 495 bp, Artificial Sequence; identical to SEQ ID NO: 2237
  Oligonucleotide

SEQ ID NO: 4518 - DNA, 495 bp, Artificial Sequence; identical to SEQ ID NO: 2238
  Oligonucleotide

SEQ ID NO: 4519 - DNA, 495 bp, Artificial Sequence; identical to SEQ ID NO: 2239
  Oligonucleotide

SEQ ID NO: 4520 - DNA, 495 bp, Artificial Sequence; identical to SEQ ID NO: 2240
  Oligonucleotide

SEQ ID NO: 4521 - DNA, 495 bp, Artificial Sequence; identical to SEQ ID NO: 2241
  Oligonucleotide

SEQ ID NO: 4522 - DNA, 495 bp, Artificial Sequence; identical to SEQ ID NO: 2242
  Oligonucleotide

SEQ ID NO: 4523 - DNA, 495 bp, Artificial Sequence; identical to SEQ ID NO: 2243
  Oligonucleotide

SEQ ID NO: 4524 - DNA, 495 bp, Artificial Sequence; identical to SEQ ID NO: 2244
  Oligonucleotide

SEQ ID NO: 4525 - DNA, 495 bp, Artificial Sequence; identical to SEQ ID NO: 2245
  Oligonucleotide

SEQ ID NO: 4526 - DNA, 495 bp, Artificial Sequence; identical to SEQ ID NO: 2246
  Oligonucleotide

SEQ ID NO: 4527 - DNA, 495 bp, Artificial Sequence; identical to SEQ ID NO: 2247
  Oligonucleotide

SEQ ID NO: 4528 - DNA, 495 bp, Artificial Sequence; identical to SEQ ID NO: 2248
  Oligonucleotide

SEQ ID NO: 4529 - DNA, 495 bp, Artificial Sequence; identical to SEQ ID NO: 2249
  Oligonucleotide

SEQ ID NO: 4530 - DNA, 495 bp, Artificial Sequence; identical to SEQ ID NO: 2250
  Oligonucleotide

SEQ ID NO: 4531 - DNA, 495 bp, Artificial Sequence; identical to SEQ ID NO: 2251
  Oligonucleotide

SEQ ID NO: 4532 - DNA, 495 bp, Artificial Sequence; identical to SEQ ID NO: 2252
  Oligonucleotide

SEQ ID NO: 4533 - DNA, 495 bp, Artificial Sequence; identical to SEQ ID NO: 2253
  Oligonucleotide

SEQ ID NO: 4534 - DNA, 495 bp, Artificial Sequence; identical to SEQ ID NO: 2254
  Oligonucleotide

SEQ ID NO: 4535 - DNA, 495 bp, Artificial Sequence; identical to SEQ ID NO: 2255
  Oligonucleotide

SEQ ID NO: 4536 - DNA, 495 bp, Artificial Sequence; identical to SEQ ID NO: 2256
  Oligonucleotide

SEQ ID NO: 4537 - DNA, 495 bp, Artificial Sequence; identical to SEQ ID NO: 2257
  Oligonucleotide

SEQ ID NO: 4538 - DNA, 495 bp, Artificial Sequence; identical to SEQ ID NO: 2258
  Oligonucleotide

SEQ ID NO: 4539 - DNA, 495 bp, Artificial Sequence; identical to SEQ ID NO: 2259
  Oligonucleotide

SEQ ID NO: 4540 - DNA, 495 bp, Artificial Sequence; identical to SEQ ID NO: 2260
  Oligonucleotide

SEQ ID NO: 4541 - DNA, 495 bp, Artificial Sequence; identical to SEQ ID NO: 2261
  Oligonucleotide

SEQ ID NO: 4542 - DNA, 495 bp, Artificial Sequence; identical to SEQ ID NO: 2262
  Oligonucleotide

SEQ ID NO: 4543 - DNA, 495 bp, Artificial Sequence; identical to SEQ ID NO: 2263
  Oligonucleotide

SEQ ID NO: 4544 - DNA, 495 bp, Artificial Sequence; identical to SEQ ID NO: 2264
  Oligonucleotide

SEQ ID NO: 4545 - DNA, 495 bp, Artificial Sequence; identical to SEQ ID NO: 2265
  Oligonucleotide

SEQ ID NO: 4546 - DNA, 495 bp, Artificial Sequence; identical to SEQ ID NO: 2266
  Oligonucleotide

SEQ ID NO: 4547 - DNA, 495 bp, Artificial Sequence; identical to SEQ ID NO: 2267
  Oligonucleotide

SEQ ID NO: 4548 - DNA, 495 bp, Artificial Sequence; identical to SEQ ID NO: 2268
  Oligonucleotide

SEQ ID NO: 4549 - DNA, 495 bp, Artificial Sequence; identical to SEQ ID NO: 2269
  Oligonucleotide

SEQ ID NO: 4550 - DNA, 495 bp, Artificial Sequence; identical to SEQ ID NO: 2270
  Oligonucleotide

SEQ ID NO: 4551 - DNA, 495 bp, Artificial Sequence; identical to SEQ ID NO: 2271
  Oligonucleotide

SEQ ID NO: 4552 - DNA, 495 bp, Artificial Sequence; identical to SEQ ID NO: 2272
  Oligonucleotide

SEQ ID NO: 4553 - DNA, 495 bp, Artificial Sequence; identical to SEQ ID NO: 2273
  Oligonucleotide

SEQ ID NO: 4554 - DNA, 495 bp, Artificial Sequence; identical to SEQ ID NO: 2274
  Oligonucleotide

SEQ ID NO: 4555 - DNA, 495 bp, Artificial Sequence; identical to SEQ ID NO: 2275
  Oligonucleotide

SEQ ID NO: 4556 - DNA, 495 bp, Artificial Sequence; identical to SEQ ID NO: 2276
  Oligonucleotide

SEQ ID NO: 4557 - DNA, 495 bp, Artificial Sequence; identical to SEQ ID NO: 2277
  Oligonucleotide

SEQ ID NO: 4558 - DNA, 495 bp, Artificial Sequence; identical to SEQ ID NO: 2278
  Oligonucleotide

SEQ ID NO: 4559 - DNA, 495 bp, Artificial Sequence; identical to SEQ ID NO: 2279
  Oligonucleotide

SEQ ID NO: 4560 - DNA, 495 bp, Artificial Sequence; identical to SEQ ID NO: 2280
  Oligonucleotide

SEQ ID NO: 4561 - DNA, 495 bp, Artificial Sequence; identical to SEQ ID NO: 2281
  Oligonucleotide

SEQ ID NO: 4562 - DNA, 495 bp, Artificial Sequence; identical to SEQ ID NO: 2282
  Oligonucleotide

SEQ ID NO: 4563 - DNA, 495 bp, Artificial Sequence; identical to SEQ ID NO: 2283
  Oligonucleotide

SEQ ID NO: 4564 - DNA, 495 bp, Artificial Sequence; identical to SEQ ID NO: 2284
  Oligonucleotide

SEQ ID NO: 4565 - DNA, 495 bp, Artificial Sequence; identical to SEQ ID NO: 2285
  Oligonucleotide

SEQ ID NO: 4566 - DNA, 495 bp, Artificial Sequence; identical to SEQ ID NO: 2286
  Oligonucleotide

SEQ ID NO: 4567 - DNA, 495 bp, Artificial Sequence; identical to SEQ ID NO: 2287
  Oligonucleotide

SEQ ID NO: 4568 - DNA, 495 bp, Artificial Sequence; identical to SEQ ID NO: 2288
  Oligonucleotide

SEQ ID NO: 4569 - DNA, 495 bp, Artificial Sequence; identical to SEQ ID NO: 2289
  Oligonucleotide

SEQ ID NO: 4570 - DNA, 495 bp, Artificial Sequence; identical to SEQ ID NO: 2290
  Oligonucleotide

SEQ ID NO: 4571 - DNA, 495 bp, Artificial Sequence; identical to SEQ ID NO: 2291
  Oligonucleotide

SEQ ID NO: 4572 - DNA, 495 bp, Artificial Sequence; identical to SEQ ID NO: 2292
  Oligonucleotide

SEQ ID NO: 4573 - DNA, 495 bp, Artificial Sequence; identical to SEQ ID NO: 2293
  Oligonucleotide

SEQ ID NO: 4574 - DNA, 495 bp, Artificial Sequence; identical to SEQ ID NO: 2294
  Oligonucleotide

SEQ ID NO: 4575 - DNA, 495 bp, Artificial Sequence; identical to SEQ ID NO: 2295
  Oligonucleotide

SEQ ID NO: 4576 - DNA, 495 bp, Artificial Sequence; identical to SEQ ID NO: 2296
  Oligonucleotide

SEQ ID NO: 4577 - DNA, 495 bp, Artificial Sequence; identical to SEQ ID NO: 2297
  Oligonucleotide

SEQ ID NO: 4578 - DNA, 495 bp, Artificial Sequence; identical to SEQ ID NO: 2298
  Oligonucleotide

SEQ ID NO: 4579 - DNA, 448 bp, Artificial Sequence; identical to SEQ ID NO: 2299
  Oligonucleotide

SEQ ID NO: 4580 - DNA, 495 bp, Artificial Sequence; identical to SEQ ID NO: 2300
  Oligonucleotide

SEQ ID NO: 4581 - DNA, 495 bp, Artificial Sequence; identical to SEQ ID NO: 2301
  Oligonucleotide

SEQ ID NO: 4582 - DNA, 495 bp, Artificial Sequence; identical to SEQ ID NO: 2302
  Oligonucleotide

SEQ ID NO: 4583 - DNA, 495 bp, Artificial Sequence; identical to SEQ ID NO: 2303
  Oligonucleotide

SEQ ID NO: 4584 - DNA, 495 bp, Artificial Sequence; identical to SEQ ID NO: 2304
  Oligonucleotide

SEQ ID NO: 4585 - DNA, 495 bp, Artificial Sequence; identical to SEQ ID NO: 2305
  Oligonucleotide

SEQ ID NO: 4586 - DNA, 495 bp, Artificial Sequence; identical to SEQ ID NO: 2306
  Oligonucleotide

SEQ ID NO: 4587 - DNA, 495 bp, Artificial Sequence; identical to SEQ ID NO: 2307
  Oligonucleotide

SEQ ID NO: 4588 - DNA, 495 bp, Artificial Sequence; identical to SEQ ID NO: 2308
  Oligonucleotide

SEQ ID NO: 4589 - DNA, 495 bp, Artificial Sequence; identical to SEQ ID NO: 2309
  Oligonucleotide

SEQ ID NO: 4590 - DNA, 495 bp, Artificial Sequence; identical to SEQ ID NO: 2310
  Oligonucleotide

SEQ ID NO: 4591 - DNA, 495 bp, Artificial Sequence; identical to SEQ ID NO: 2311
  Oligonucleotide

SEQ ID NO: 4592 - DNA, 495 bp, Artificial Sequence; identical to SEQ ID NO: 2312
  Oligonucleotide

SEQ ID NO: 4593 - DNA, 495 bp, Artificial Sequence; identical to SEQ ID NO: 2313
  Oligonucleotide

SEQ ID NO: 4594 - DNA, 495 bp, Artificial Sequence; identical to SEQ ID NO: 2314
  Oligonucleotide

SEQ ID NO: 4595 - DNA, 495 bp, Artificial Sequence; identical to SEQ ID NO: 2315
  Oligonucleotide

SEQ ID NO: 4596 - DNA, 495 bp, Artificial Sequence; identical to SEQ ID NO: 2316
  Oligonucleotide

SEQ ID NO: 4597 - DNA, 495 bp, Artificial Sequence; identical to SEQ ID NO: 2317
  Oligonucleotide

SEQ ID NO: 4598 - DNA, 495 bp, Artificial Sequence; identical to SEQ ID NO: 2318
  Oligonucleotide

SEQ ID NO: 4599 - DNA, 495 bp, Artificial Sequence; identical to SEQ ID NO: 2319
  Oligonucleotide

SEQ ID NO: 4600 - DNA, 495 bp, Artificial Sequence; identical to SEQ ID NO: 2320
  Oligonucleotide

SEQ ID NO: 4601 - DNA, 495 bp, Artificial Sequence; identical to SEQ ID NO: 2321
  Oligonucleotide

SEQ ID NO: 4602 - DNA, 495 bp, Artificial Sequence; identical to SEQ ID NO: 2322
  Oligonucleotide

SEQ ID NO: 4603 - DNA, 495 bp, Artificial Sequence; identical to SEQ ID NO: 2323
  Oligonucleotide

SEQ ID NO: 4604 - DNA, 495 bp, Artificial Sequence; identical to SEQ ID NO: 2324
  Oligonucleotide

SEQ ID NO: 4605 - DNA, 495 bp, Artificial Sequence; identical to SEQ ID NO: 2325
  Oligonucleotide

SEQ ID NO: 4606 - DNA, 495 bp, Artificial Sequence; identical to SEQ ID NO: 2326
  Oligonucleotide

SEQ ID NO: 4607 - DNA, 495 bp, Artificial Sequence; identical to SEQ ID NO: 2327
  Oligonucleotide

SEQ ID NO: 4608 - DNA, 495 bp, Artificial Sequence; identical to SEQ ID NO: 2328
  Oligonucleotide

SEQ ID NO: 4609 - DNA, 495 bp, Artificial Sequence; identical to SEQ ID NO: 2329
  Oligonucleotide

SEQ ID NO: 4610 - DNA, 495 bp, Artificial Sequence; identical to SEQ ID NO: 2330
  Oligonucleotide

SEQ ID NO: 4611 - DNA, 495 bp, Artificial Sequence; identical to SEQ ID NO: 2331
  Oligonucleotide

SEQ ID NO: 4612 - DNA, 495 bp, Artificial Sequence; identical to SEQ ID NO: 2332
  Oligonucleotide

SEQ ID NO: 4613 - DNA, 495 bp, Artificial Sequence; identical to SEQ ID NO: 2333
  Oligonucleotide

SEQ ID NO: 4614 - DNA, 495 bp, Artificial Sequence; identical to SEQ ID NO: 2334
  Oligonucleotide

SEQ ID NO: 4615 - DNA, 495 bp, Artificial Sequence; identical to SEQ ID NO: 2335
  Oligonucleotide

SEQ ID NO: 4616 - DNA, 495 bp, Artificial Sequence; identical to SEQ ID NO: 2336
  Oligonucleotide

SEQ ID NO: 4617 - DNA, 495 bp, Artificial Sequence; identical to SEQ ID NO: 2337
  Oligonucleotide

SEQ ID NO: 4618 - DNA, 495 bp, Artificial Sequence; identical to SEQ ID NO: 2338
  Oligonucleotide

SEQ ID NO: 4619 - DNA, 495 bp, Artificial Sequence; identical to SEQ ID NO: 2339
  Oligonucleotide

SEQ ID NO: 4620 - DNA, 495 bp, Artificial Sequence; identical to SEQ ID NO: 2340
  Oligonucleotide

SEQ ID NO: 4621 - DNA, 495 bp, Artificial Sequence; identical to SEQ ID NO: 2341
  Oligonucleotide

SEQ ID NO: 4622 - DNA, 495 bp, Artificial Sequence; identical to SEQ ID NO: 2342
  Oligonucleotide

SEQ ID NO: 4623 - DNA, 495 bp, Artificial Sequence; identical to SEQ ID NO: 2343
  Oligonucleotide

SEQ ID NO: 4624 - DNA, 495 bp, Artificial Sequence; identical to SEQ ID NO: 2344
  Oligonucleotide

SEQ ID NO: 4625 - DNA, 495 bp, Artificial Sequence; identical to SEQ ID NO: 2345
  Oligonucleotide

SEQ ID NO: 4626 - DNA, 495 bp, Artificial Sequence; identical to SEQ ID NO: 2346
  Oligonucleotide

SEQ ID NO: 4627 - DNA, 495 bp, Artificial Sequence; identical to SEQ ID NO: 2347
  Oligonucleotide

SEQ ID NO: 4628 - DNA, 495 bp, Artificial Sequence; identical to SEQ ID NO: 2348
  Oligonucleotide

SEQ ID NO: 4629 - DNA, 495 bp, Artificial Sequence; identical to SEQ ID NO: 2349
  Oligonucleotide

SEQ ID NO: 4630 - DNA, 495 bp, Artificial Sequence; identical to SEQ ID NO: 2350
  Oligonucleotide

SEQ ID NO: 4631 - DNA, 495 bp, Artificial Sequence; identical to SEQ ID NO: 2351
  Oligonucleotide

SEQ ID NO: 4632 - DNA, 495 bp, Artificial Sequence; identical to SEQ ID NO: 2352
  Oligonucleotide

SEQ ID NO: 4633 - DNA, 495 bp, Artificial Sequence; identical to SEQ ID NO: 2353
  Oligonucleotide

SEQ ID NO: 4634 - DNA, 495 bp, Artificial Sequence; identical to SEQ ID NO: 2354
  Oligonucleotide

SEQ ID NO: 4635 - DNA, 495 bp, Artificial Sequence; identical to SEQ ID NO: 2355
  Oligonucleotide

SEQ ID NO: 4636 - DNA, 495 bp, Artificial Sequence; identical to SEQ ID NO: 2356
  Oligonucleotide

SEQ ID NO: 4637 - DNA, 495 bp, Artificial Sequence; identical to SEQ ID NO: 2357
  Oligonucleotide

SEQ ID NO: 4638 - DNA, 495 bp, Artificial Sequence; identical to SEQ ID NO: 2358
  Oligonucleotide

SEQ ID NO: 4639 - DNA, 495 bp, Artificial Sequence; identical to SEQ ID NO: 2359
  Oligonucleotide

SEQ ID NO: 4640 - DNA, 495 bp, Artificial Sequence; identical to SEQ ID NO: 2360
  Oligonucleotide

SEQ ID NO: 4641 - DNA, 495 bp, Artificial Sequence; identical to SEQ ID NO: 2361
  Oligonucleotide

SEQ ID NO: 4642 - DNA, 495 bp, Artificial Sequence; identical to SEQ ID NO: 2362
  Oligonucleotide

SEQ ID NO: 4643 - DNA, 495 bp, Artificial Sequence; identical to SEQ ID NO: 2363
  Oligonucleotide

SEQ ID NO: 4644 - DNA, 495 bp, Artificial Sequence; identical to SEQ ID NO: 2364
  Oligonucleotide

SEQ ID NO: 4645 - DNA, 495 bp, Artificial Sequence; identical to SEQ ID NO: 2365
  Oligonucleotide

SEQ ID NO: 4646 - DNA, 495 bp, Artificial Sequence; identical to SEQ ID NO: 2366
  Oligonucleotide

SEQ ID NO: 4647 - DNA, 495 bp, Artificial Sequence; identical to SEQ ID NO: 2367
  Oligonucleotide

SEQ ID NO: 4648 - DNA, 495 bp, Artificial Sequence; identical to SEQ ID NO: 2368
  Oligonucleotide

SEQ ID NO: 4649 - DNA, 495 bp, Artificial Sequence; identical to SEQ ID NO: 2369
  Oligonucleotide

SEQ ID NO: 4650 - DNA, 495 bp, Artificial Sequence; identical to SEQ ID NO: 2370
  Oligonucleotide

SEQ ID NO: 4651 - DNA, 495 bp, Artificial Sequence; identical to SEQ ID NO: 2371
  Oligonucleotide

SEQ ID NO: 4652 - DNA, 495 bp, Artificial Sequence; identical to SEQ ID NO: 2372
  Oligonucleotide

SEQ ID NO: 4653 - DNA, 495 bp, Artificial Sequence; identical to SEQ ID NO: 2373
  Oligonucleotide

SEQ ID NO: 4654 - DNA, 495 bp, Artificial Sequence; identical to SEQ ID NO: 2374
  Oligonucleotide

SEQ ID NO: 4655 - DNA, 495 bp, Artificial Sequence; identical to SEQ ID NO: 2375
  Oligonucleotide

SEQ ID NO: 4656 - DNA, 495 bp, Artificial Sequence; identical to SEQ ID NO: 2376
  Oligonucleotide

SEQ ID NO: 4657 - DNA, 495 bp, Artificial Sequence; identical to SEQ ID NO: 2377
  Oligonucleotide

SEQ ID NO: 4658 - DNA, 495 bp, Artificial Sequence; identical to SEQ ID NO: 2378
  Oligonucleotide

SEQ ID NO: 4659 - DNA, 495 bp, Artificial Sequence; identical to SEQ ID NO: 2379
  Oligonucleotide

SEQ ID NO: 4660 - DNA, 495 bp, Artificial Sequence; identical to SEQ ID NO: 2380
  Oligonucleotide

SEQ ID NO: 4661 - DNA, 495 bp, Artificial Sequence; identical to SEQ ID NO: 2381
  Oligonucleotide

SEQ ID NO: 4662 - DNA, 495 bp, Artificial Sequence; identical to SEQ ID NO: 2382
  Oligonucleotide

SEQ ID NO: 4663 - DNA, 495 bp, Artificial Sequence; identical to SEQ ID NO: 2383
  Oligonucleotide

SEQ ID NO: 4664 - DNA, 495 bp, Artificial Sequence; identical to SEQ ID NO: 2384
  Oligonucleotide

SEQ ID NO: 4665 - DNA, 495 bp, Artificial Sequence; identical to SEQ ID NO: 2385
  Oligonucleotide

SEQ ID NO: 4666 - DNA, 495 bp, Artificial Sequence; identical to SEQ ID NO: 2386
  Oligonucleotide

SEQ ID NO: 4667 - DNA, 495 bp, Artificial Sequence; identical to SEQ ID NO: 2387
  Oligonucleotide

SEQ ID NO: 4668 - DNA, 495 bp, Artificial Sequence; identical to SEQ ID NO: 2388
  Oligonucleotide

SEQ ID NO: 4669 - DNA, 495 bp, Artificial Sequence; identical to SEQ ID NO: 2389
  Oligonucleotide

SEQ ID NO: 4670 - DNA, 495 bp, Artificial Sequence; identical to SEQ ID NO: 2390
  Oligonucleotide

SEQ ID NO: 4671 - DNA, 495 bp, Artificial Sequence; identical to SEQ ID NO: 2391
  Oligonucleotide

SEQ ID NO: 4672 - DNA, 495 bp, Artificial Sequence; identical to SEQ ID NO: 2392
  Oligonucleotide

SEQ ID NO: 4673 - DNA, 495 bp, Artificial Sequence; identical to SEQ ID NO: 2393
  Oligonucleotide

SEQ ID NO: 4674 - DNA, 495 bp, Artificial Sequence; identical to SEQ ID NO: 2394
  Oligonucleotide

SEQ ID NO: 4675 - DNA, 495 bp, Artificial Sequence; identical to SEQ ID NO: 2395
  Oligonucleotide

SEQ ID NO: 4676 - DNA, 495 bp, Artificial Sequence; identical to SEQ ID NO: 2396
  Oligonucleotide

SEQ ID NO: 4677 - DNA, 495 bp, Artificial Sequence; identical to SEQ ID NO: 2397
  Oligonucleotide

SEQ ID NO: 4678 - DNA, 495 bp, Artificial Sequence; identical to SEQ ID NO: 2398
  Oligonucleotide

SEQ ID NO: 4679 - DNA, 495 bp, Artificial Sequence; identical to SEQ ID NO: 2399
  Oligonucleotide

SEQ ID NO: 4680 - DNA, 495 bp, Artificial Sequence; identical to SEQ ID NO: 2400
  Oligonucleotide

SEQ ID NO: 4681 - DNA, 495 bp, Artificial Sequence; identical to SEQ ID NO: 2401
  Oligonucleotide

SEQ ID NO: 4682 - DNA, 495 bp, Artificial Sequence; identical to SEQ ID NO: 2402
  Oligonucleotide

SEQ ID NO: 4683 - DNA, 495 bp, Artificial Sequence; identical to SEQ ID NO: 2403
  Oligonucleotide

SEQ ID NO: 4684 - DNA, 495 bp, Artificial Sequence; identical to SEQ ID NO: 2404
  Oligonucleotide

SEQ ID NO: 4685 - DNA, 495 bp, Artificial Sequence; identical to SEQ ID NO: 2405
  Oligonucleotide

SEQ ID NO: 4686 - DNA, 495 bp, Artificial Sequence; identical to SEQ ID NO: 2406
  Oligonucleotide

SEQ ID NO: 4687 - DNA, 495 bp, Artificial Sequence; identical to SEQ ID NO: 2407
  Oligonucleotide

SEQ ID NO: 4688 - DNA, 495 bp, Artificial Sequence; identical to SEQ ID NO: 2408
  Oligonucleotide

SEQ ID NO: 4689 - DNA, 495 bp, Artificial Sequence; identical to SEQ ID NO: 2409
  Oligonucleotide

SEQ ID NO: 4690 - DNA, 495 bp, Artificial Sequence; identical to SEQ ID NO: 2410
  Oligonucleotide

SEQ ID NO: 4691 - DNA, 495 bp, Artificial Sequence; identical to SEQ ID NO: 2411
  Oligonucleotide

SEQ ID NO: 4692 - DNA, 495 bp, Artificial Sequence; identical to SEQ ID NO: 2412
  Oligonucleotide

SEQ ID NO: 4693 - DNA, 495 bp, Artificial Sequence; identical to SEQ ID NO: 2413
  Oligonucleotide

SEQ ID NO: 4694 - DNA, 495 bp, Artificial Sequence; identical to SEQ ID NO: 2414
  Oligonucleotide

SEQ ID NO: 4695 - DNA, 495 bp, Artificial Sequence; identical to SEQ ID NO: 2415
  Oligonucleotide

SEQ ID NO: 4696 - DNA, 495 bp, Artificial Sequence; identical to SEQ ID NO: 2416
  Oligonucleotide

SEQ ID NO: 4697 - DNA, 495 bp, Artificial Sequence; identical to SEQ ID NO: 2417
  Oligonucleotide

SEQ ID NO: 4698 - DNA, 495 bp, Artificial Sequence; identical to SEQ ID NO: 2418
  Oligonucleotide

SEQ ID NO: 4699 - DNA, 495 bp, Artificial Sequence; identical to SEQ ID NO: 2419
  Oligonucleotide

SEQ ID NO: 4700 - DNA, 495 bp, Artificial Sequence; identical to SEQ ID NO: 2420
  Oligonucleotide

SEQ ID NO: 4701 - DNA, 495 bp, Artificial Sequence; identical to SEQ ID NO: 2421
  Oligonucleotide

SEQ ID NO: 4702 - DNA, 495 bp, Artificial Sequence; identical to SEQ ID NO: 2422
  Oligonucleotide

SEQ ID NO: 4703 - DNA, 448 bp, Artificial Sequence; identical to SEQ ID NO: 2423
  Oligonucleotide

SEQ ID NO: 4704 - DNA, 495 bp, Artificial Sequence; identical to SEQ ID NO: 2424
  Oligonucleotide

SEQ ID NO: 4705 - DNA, 495 bp, Artificial Sequence; identical to SEQ ID NO: 2425
  Oligonucleotide

SEQ ID NO: 4706 - DNA, 495 bp, Artificial Sequence; identical to SEQ ID NO: 2426
  Oligonucleotide

SEQ ID NO: 4707 - DNA, 495 bp, Artificial Sequence; identical to SEQ ID NO: 2427
  Oligonucleotide

SEQ ID NO: 4708 - DNA, 495 bp, Artificial Sequence; identical to SEQ ID NO: 2428
  Oligonucleotide

SEQ ID NO: 4709 - DNA, 495 bp, Artificial Sequence; identical to SEQ ID NO: 2429
  Oligonucleotide

SEQ ID NO: 4710 - DNA, 495 bp, Artificial Sequence; identical to SEQ ID NO: 2430
  Oligonucleotide

SEQ ID NO: 4711 - DNA, 495 bp, Artificial Sequence; identical to SEQ ID NO: 2431
  Oligonucleotide

SEQ ID NO: 4712 - DNA, 495 bp, Artificial Sequence; identical to SEQ ID NO: 2432
  Oligonucleotide

SEQ ID NO: 4713 - DNA, 495 bp, Artificial Sequence; identical to SEQ ID NO: 2433
  Oligonucleotide

SEQ ID NO: 4714 - DNA, 495 bp, Artificial Sequence; identical to SEQ ID NO: 2434
  Oligonucleotide

SEQ ID NO: 4715 - DNA, 495 bp, Artificial Sequence; identical to SEQ ID NO: 2435
  Oligonucleotide

SEQ ID NO: 4716 - DNA, 495 bp, Artificial Sequence; identical to SEQ ID NO: 2436
  Oligonucleotide

SEQ ID NO: 4717 - DNA, 495 bp, Artificial Sequence; identical to SEQ ID NO: 2437
  Oligonucleotide

SEQ ID NO: 4718 - DNA, 495 bp, Artificial Sequence; identical to SEQ ID NO: 2438
  Oligonucleotide

SEQ ID NO: 4719 - DNA, 495 bp, Artificial Sequence; identical to SEQ ID NO: 2439
  Oligonucleotide

SEQ ID NO: 4720 - DNA, 495 bp, Artificial Sequence; identical to SEQ ID NO: 2440
  Oligonucleotide

SEQ ID NO: 4721 - DNA, 495 bp, Artificial Sequence; identical to SEQ ID NO: 2441
  Oligonucleotide

SEQ ID NO: 4722 - DNA, 495 bp, Artificial Sequence; identical to SEQ ID NO: 2442
  Oligonucleotide

SEQ ID NO: 4723 - DNA, 495 bp, Artificial Sequence; identical to SEQ ID NO: 2443
  Oligonucleotide

SEQ ID NO: 4724 - DNA, 495 bp, Artificial Sequence; identical to SEQ ID NO: 2444
  Oligonucleotide

SEQ ID NO: 4725 - DNA, 495 bp, Artificial Sequence; identical to SEQ ID NO: 2445
  Oligonucleotide

SEQ ID NO: 4726 - DNA, 495 bp, Artificial Sequence; identical to SEQ ID NO: 2446
  Oligonucleotide

SEQ ID NO: 4727 - DNA, 495 bp, Artificial Sequence; identical to SEQ ID NO: 2447
  Oligonucleotide

SEQ ID NO: 4728 - DNA, 495 bp, Artificial Sequence; identical to SEQ ID NO: 2448
  Oligonucleotide

SEQ ID NO: 4729 - DNA, 495 bp, Artificial Sequence; identical to SEQ ID NO: 2449
  Oligonucleotide

SEQ ID NO: 4730 - DNA, 495 bp, Artificial Sequence; identical to SEQ ID NO: 2450
  Oligonucleotide

SEQ ID NO: 4731 - DNA, 495 bp, Artificial Sequence; identical to SEQ ID NO: 2451
  Oligonucleotide

SEQ ID NO: 4732 - DNA, 495 bp, Artificial Sequence; identical to SEQ ID NO: 2452
  Oligonucleotide

SEQ ID NO: 4733 - DNA, 495 bp, Artificial Sequence; identical to SEQ ID NO: 2453
  Oligonucleotide

SEQ ID NO: 4734 - DNA, 495 bp, Artificial Sequence; identical to SEQ ID NO: 2454
  Oligonucleotide

SEQ ID NO: 4735 - DNA, 495 bp, Artificial Sequence; identical to SEQ ID NO: 2455
  Oligonucleotide

SEQ ID NO: 4736 - DNA, 495 bp, Artificial Sequence; identical to SEQ ID NO: 2456
  Oligonucleotide

SEQ ID NO: 4737 - DNA, 495 bp, Artificial Sequence; identical to SEQ ID NO: 2457
  Oligonucleotide

SEQ ID NO: 4738 - DNA, 495 bp, Artificial Sequence; identical to SEQ ID NO: 2458
  Oligonucleotide

SEQ ID NO: 4739 - DNA, 495 bp, Artificial Sequence; identical to SEQ ID NO: 2459
  Oligonucleotide

SEQ ID NO: 4740 - DNA, 495 bp, Artificial Sequence; identical to SEQ ID NO: 2460
  Oligonucleotide

SEQ ID NO: 4741 - DNA, 495 bp, Artificial Sequence; identical to SEQ ID NO: 2461
  Oligonucleotide

SEQ ID NO: 4742 - DNA, 495 bp, Artificial Sequence; identical to SEQ ID NO: 2462
  Oligonucleotide

SEQ ID NO: 4743 - DNA, 495 bp, Artificial Sequence; identical to SEQ ID NO: 2463
  Oligonucleotide

SEQ ID NO: 4744 - DNA, 495 bp, Artificial Sequence; identical to SEQ ID NO: 2464
  Oligonucleotide

SEQ ID NO: 4745 - DNA, 495 bp, Artificial Sequence; identical to SEQ ID NO: 2465
  Oligonucleotide

SEQ ID NO: 4746 - DNA, 495 bp, Artificial Sequence; identical to SEQ ID NO: 2466
  Oligonucleotide

SEQ ID NO: 4747 - DNA, 495 bp, Artificial Sequence; identical to SEQ ID NO: 2467
  Oligonucleotide

SEQ ID NO: 4748 - DNA, 495 bp, Artificial Sequence; identical to SEQ ID NO: 2468
  Oligonucleotide

SEQ ID NO: 4749 - DNA, 495 bp, Artificial Sequence; identical to SEQ ID NO: 2469
  Oligonucleotide

SEQ ID NO: 4750 - DNA, 495 bp, Artificial Sequence; identical to SEQ ID NO: 2470
  Oligonucleotide

SEQ ID NO: 4751 - DNA, 495 bp, Artificial Sequence; identical to SEQ ID NO: 2471
  Oligonucleotide

SEQ ID NO: 4752 - DNA, 495 bp, Artificial Sequence; identical to SEQ ID NO: 2472
  Oligonucleotide

SEQ ID NO: 4753 - DNA, 495 bp, Artificial Sequence; identical to SEQ ID NO: 2473
  Oligonucleotide

SEQ ID NO: 4754 - DNA, 495 bp, Artificial Sequence; identical to SEQ ID NO: 2474
  Oligonucleotide

SEQ ID NO: 4755 - DNA, 495 bp, Artificial Sequence; identical to SEQ ID NO: 2475
  Oligonucleotide

SEQ ID NO: 4756 - DNA, 495 bp, Artificial Sequence; identical to SEQ ID NO: 2476
  Oligonucleotide

SEQ ID NO: 4757 - DNA, 495 bp, Artificial Sequence; identical to SEQ ID NO: 2477
  Oligonucleotide

SEQ ID NO: 4758 - DNA, 495 bp, Artificial Sequence; identical to SEQ ID NO: 2478
  Oligonucleotide

SEQ ID NO: 4759 - DNA, 495 bp, Artificial Sequence; identical to SEQ ID NO: 2479
  Oligonucleotide

SEQ ID NO: 4760 - DNA, 495 bp, Artificial Sequence; identical to SEQ ID NO: 2480
  Oligonucleotide

SEQ ID NO: 4761 - DNA, 495 bp, Artificial Sequence; identical to SEQ ID NO: 2481
  Oligonucleotide

SEQ ID NO: 4762 - DNA, 495 bp, Artificial Sequence; identical to SEQ ID NO: 2482
  Oligonucleotide

SEQ ID NO: 4763 - DNA, 495 bp, Artificial Sequence; identical to SEQ ID NO: 2483
  Oligonucleotide

SEQ ID NO: 4764 - DNA, 495 bp, Artificial Sequence; identical to SEQ ID NO: 2484
  Oligonucleotide

SEQ ID NO: 4765 - DNA, 495 bp, Artificial Sequence; identical to SEQ ID NO: 2485
  Oligonucleotide

SEQ ID NO: 4766 - DNA, 495 bp, Artificial Sequence; identical to SEQ ID NO: 2486
  Oligonucleotide

SEQ ID NO: 4767 - DNA, 495 bp, Artificial Sequence; identical to SEQ ID NO: 2487
  Oligonucleotide

SEQ ID NO: 4768 - DNA, 495 bp, Artificial Sequence; identical to SEQ ID NO: 2488
  Oligonucleotide

SEQ ID NO: 4769 - DNA, 495 bp, Artificial Sequence; identical to SEQ ID NO: 2489
  Oligonucleotide

SEQ ID NO: 4770 - DNA, 495 bp, Artificial Sequence; identical to SEQ ID NO: 2490
  Oligonucleotide

SEQ ID NO: 4771 - DNA, 495 bp, Artificial Sequence; identical to SEQ ID NO: 2491
  Oligonucleotide

SEQ ID NO: 4772 - DNA, 495 bp, Artificial Sequence; identical to SEQ ID NO: 2492
  Oligonucleotide

SEQ ID NO: 4773 - DNA, 495 bp, Artificial Sequence; identical to SEQ ID NO: 2493
  Oligonucleotide

SEQ ID NO: 4774 - DNA, 495 bp, Artificial Sequence; identical to SEQ ID NO: 2494
  Oligonucleotide

SEQ ID NO: 4775 - DNA, 495 bp, Artificial Sequence; identical to SEQ ID NO: 2495
  Oligonucleotide

SEQ ID NO: 4776 - DNA, 495 bp, Artificial Sequence; identical to SEQ ID NO: 2496
  Oligonucleotide

SEQ ID NO: 4777 - DNA, 495 bp, Artificial Sequence; identical to SEQ ID NO: 2497
  Oligonucleotide

SEQ ID NO: 4778 - DNA, 495 bp, Artificial Sequence; identical to SEQ ID NO: 2498
  Oligonucleotide

SEQ ID NO: 4779 - DNA, 495 bp, Artificial Sequence; identical to SEQ ID NO: 2499
  Oligonucleotide

SEQ ID NO: 4780 - DNA, 495 bp, Artificial Sequence; identical to SEQ ID NO: 2500
  Oligonucleotide

SEQ ID NO: 4781 - DNA, 495 bp, Artificial Sequence; identical to SEQ ID NO: 2501
  Oligonucleotide

SEQ ID NO: 4782 - DNA, 495 bp, Artificial Sequence; identical to SEQ ID NO: 2502
  Oligonucleotide

SEQ ID NO: 4783 - DNA, 495 bp, Artificial Sequence; identical to SEQ ID NO: 2503
  Oligonucleotide

SEQ ID NO: 4784 - DNA, 495 bp, Artificial Sequence; identical to SEQ ID NO: 2504
  Oligonucleotide

SEQ ID NO: 4785 - DNA, 495 bp, Artificial Sequence; identical to SEQ ID NO: 2505
  Oligonucleotide

SEQ ID NO: 4786 - DNA, 495 bp, Artificial Sequence; identical to SEQ ID NO: 2506
  Oligonucleotide

SEQ ID NO: 4787 - DNA, 495 bp, Artificial Sequence; identical to SEQ ID NO: 2507
  Oligonucleotide

SEQ ID NO: 4788 - DNA, 495 bp, Artificial Sequence; identical to SEQ ID NO: 2508
  Oligonucleotide

SEQ ID NO: 4789 - DNA, 495 bp, Artificial Sequence; identical to SEQ ID NO: 2509
  Oligonucleotide

SEQ ID NO: 4790 - DNA, 495 bp, Artificial Sequence; identical to SEQ ID NO: 2510
  Oligonucleotide

SEQ ID NO: 4791 - DNA, 495 bp, Artificial Sequence; identical to SEQ ID NO: 2511
  Oligonucleotide

SEQ ID NO: 4792 - DNA, 495 bp, Artificial Sequence; identical to SEQ ID NO: 2512
  Oligonucleotide

SEQ ID NO: 4793 - DNA, 495 bp, Artificial Sequence; identical to SEQ ID NO: 2513
  Oligonucleotide

SEQ ID NO: 4794 - DNA, 495 bp, Artificial Sequence; identical to SEQ ID NO: 2514
  Oligonucleotide

SEQ ID NO: 4795 - DNA, 495 bp, Artificial Sequence; identical to SEQ ID NO: 2515
  Oligonucleotide

SEQ ID NO: 4796 - DNA, 495 bp, Artificial Sequence; identical to SEQ ID NO: 2516
  Oligonucleotide

SEQ ID NO: 4797 - DNA, 495 bp, Artificial Sequence; identical to SEQ ID NO: 2517
  Oligonucleotide

SEQ ID NO: 4798 - DNA, 495 bp, Artificial Sequence; identical to SEQ ID NO: 2518
  Oligonucleotide

SEQ ID NO: 4799 - DNA, 495 bp, Artificial Sequence; identical to SEQ ID NO: 2519
  Oligonucleotide

SEQ ID NO: 4800 - DNA, 495 bp, Artificial Sequence; identical to SEQ ID NO: 2520
  Oligonucleotide

SEQ ID NO: 4801 - DNA, 495 bp, Artificial Sequence; identical to SEQ ID NO: 2521
  Oligonucleotide

SEQ ID NO: 4802 - DNA, 495 bp, Artificial Sequence; identical to SEQ ID NO: 2522
  Oligonucleotide

SEQ ID NO: 4803 - DNA, 495 bp, Artificial Sequence; identical to SEQ ID NO: 2523
  Oligonucleotide

SEQ ID NO: 4804 - DNA, 495 bp, Artificial Sequence; identical to SEQ ID NO: 2524
  Oligonucleotide

SEQ ID NO: 4805 - DNA, 495 bp, Artificial Sequence; identical to SEQ ID NO: 2525
  Oligonucleotide

SEQ ID NO: 4806 - DNA, 495 bp, Artificial Sequence; identical to SEQ ID NO: 2526
  Oligonucleotide

SEQ ID NO: 4807 - DNA, 495 bp, Artificial Sequence; identical to SEQ ID NO: 2527
  Oligonucleotide

SEQ ID NO: 4808 - DNA, 495 bp, Artificial Sequence; identical to SEQ ID NO: 2528
  Oligonucleotide

SEQ ID NO: 4809 - DNA, 495 bp, Artificial Sequence; identical to SEQ ID NO: 2529
  Oligonucleotide

SEQ ID NO: 4810 - DNA, 495 bp, Artificial Sequence; identical to SEQ ID NO: 2530
  Oligonucleotide

SEQ ID NO: 4811 - DNA, 495 bp, Artificial Sequence; identical to SEQ ID NO: 2531
  Oligonucleotide

SEQ ID NO: 4812 - DNA, 495 bp, Artificial Sequence; identical to SEQ ID NO: 2532
  Oligonucleotide

SEQ ID NO: 4813 - DNA, 495 bp, Artificial Sequence; identical to SEQ ID NO: 2533
  Oligonucleotide

SEQ ID NO: 4814 - DNA, 495 bp, Artificial Sequence; identical to SEQ ID NO: 2534
  Oligonucleotide

SEQ ID NO: 4815 - DNA, 495 bp, Artificial Sequence; identical to SEQ ID NO: 2535
  Oligonucleotide

SEQ ID NO: 4816 - DNA, 495 bp, Artificial Sequence; identical to SEQ ID NO: 2536
  Oligonucleotide

SEQ ID NO: 4817 - DNA, 495 bp, Artificial Sequence; identical to SEQ ID NO: 2537
  Oligonucleotide

SEQ ID NO: 4818 - DNA, 495 bp, Artificial Sequence; identical to SEQ ID NO: 2538
  Oligonucleotide

SEQ ID NO: 4819 - DNA, 495 bp, Artificial Sequence; identical to SEQ ID NO: 2539
  Oligonucleotide

SEQ ID NO: 4820 - DNA, 495 bp, Artificial Sequence; identical to SEQ ID NO: 2540
  Oligonucleotide

SEQ ID NO: 4821 - DNA, 495 bp, Artificial Sequence; identical to SEQ ID NO: 2541
  Oligonucleotide

SEQ ID NO: 4822 - DNA, 495 bp, Artificial Sequence; identical to SEQ ID NO: 2542
  Oligonucleotide

SEQ ID NO: 4823 - DNA, 495 bp, Artificial Sequence; identical to SEQ ID NO: 2543
  Oligonucleotide

SEQ ID NO: 4824 - DNA, 495 bp, Artificial Sequence; identical to SEQ ID NO: 2544
  Oligonucleotide

SEQ ID NO: 4825 - DNA, 495 bp, Artificial Sequence; identical to SEQ ID NO: 2545
  Oligonucleotide

SEQ ID NO: 4826 - DNA, 495 bp, Artificial Sequence; identical to SEQ ID NO: 2546
  Oligonucleotide

SEQ ID NO: 4827 - DNA, 448 bp, Artificial Sequence; identical to SEQ ID NO: 2547
  Oligonucleotide

SEQ ID NO: 4828 - DNA, 495 bp, Artificial Sequence; identical to SEQ ID NO: 2548
  Oligonucleotide

SEQ ID NO: 4829 - DNA, 495 bp, Artificial Sequence; identical to SEQ ID NO: 2549
  Oligonucleotide

SEQ ID NO: 4830 - DNA, 495 bp, Artificial Sequence; identical to SEQ ID NO: 2550
  Oligonucleotide

SEQ ID NO: 4831 - DNA, 495 bp, Artificial Sequence; identical to SEQ ID NO: 2551
  Oligonucleotide

SEQ ID NO: 4832 - DNA, 495 bp, Artificial Sequence; identical to SEQ ID NO: 2552
  Oligonucleotide

SEQ ID NO: 4833 - DNA, 495 bp, Artificial Sequence; identical to SEQ ID NO: 2553
  Oligonucleotide

SEQ ID NO: 4834 - DNA, 495 bp, Artificial Sequence; identical to SEQ ID NO: 2554
  Oligonucleotide

SEQ ID NO: 4835 - DNA, 495 bp, Artificial Sequence; identical to SEQ ID NO: 2555
  Oligonucleotide

SEQ ID NO: 4836 - DNA, 495 bp, Artificial Sequence; identical to SEQ ID NO: 2556
  Oligonucleotide

SEQ ID NO: 4837 - DNA, 495 bp, Artificial Sequence; identical to SEQ ID NO: 2557
  Oligonucleotide

SEQ ID NO: 4838 - DNA, 495 bp, Artificial Sequence; identical to SEQ ID NO: 2558
  Oligonucleotide

SEQ ID NO: 4839 - DNA, 495 bp, Artificial Sequence; identical to SEQ ID NO: 2559
  Oligonucleotide

SEQ ID NO: 4840 - DNA, 495 bp, Artificial Sequence; identical to SEQ ID NO: 2560
  Oligonucleotide

SEQ ID NO: 4841 - DNA, 495 bp, Artificial Sequence; identical to SEQ ID NO: 2561
  Oligonucleotide

SEQ ID NO: 4842 - DNA, 495 bp, Artificial Sequence; identical to SEQ ID NO: 2562
  Oligonucleotide

SEQ ID NO: 4843 - DNA, 495 bp, Artificial Sequence; identical to SEQ ID NO: 2563
  Oligonucleotide

SEQ ID NO: 4844 - DNA, 495 bp, Artificial Sequence; identical to SEQ ID NO: 2564
  Oligonucleotide

SEQ ID NO: 4845 - DNA, 495 bp, Artificial Sequence; identical to SEQ ID NO: 2565
  Oligonucleotide

SEQ ID NO: 4846 - DNA, 495 bp, Artificial Sequence; identical to SEQ ID NO: 2566
  Oligonucleotide

SEQ ID NO: 4847 - DNA, 495 bp, Artificial Sequence; identical to SEQ ID NO: 2567
  Oligonucleotide

SEQ ID NO: 4848 - DNA, 495 bp, Artificial Sequence; identical to SEQ ID NO: 2568
  Oligonucleotide

SEQ ID NO: 4849 - DNA, 495 bp, Artificial Sequence; identical to SEQ ID NO: 2569
  Oligonucleotide

SEQ ID NO: 4850 - DNA, 495 bp, Artificial Sequence; identical to SEQ ID NO: 2570
  Oligonucleotide

SEQ ID NO: 4851 - DNA, 495 bp, Artificial Sequence; identical to SEQ ID NO: 2571
  Oligonucleotide

SEQ ID NO: 4852 - DNA, 495 bp, Artificial Sequence; identical to SEQ ID NO: 2572
  Oligonucleotide

SEQ ID NO: 4853 - DNA, 495 bp, Artificial Sequence; identical to SEQ ID NO: 2573
  Oligonucleotide

SEQ ID NO: 4854 - DNA, 495 bp, Artificial Sequence; identical to SEQ ID NO: 2574
  Oligonucleotide

SEQ ID NO: 4855 - DNA, 495 bp, Artificial Sequence; identical to SEQ ID NO: 2575
  Oligonucleotide

SEQ ID NO: 4856 - DNA, 495 bp, Artificial Sequence; identical to SEQ ID NO: 2576
  Oligonucleotide

SEQ ID NO: 4857 - DNA, 495 bp, Artificial Sequence; identical to SEQ ID NO: 2577
  Oligonucleotide

SEQ ID NO: 4858 - DNA, 495 bp, Artificial Sequence; identical to SEQ ID NO: 2578
  Oligonucleotide

SEQ ID NO: 4859 - DNA, 495 bp, Artificial Sequence; identical to SEQ ID NO: 2579
  Oligonucleotide

SEQ ID NO: 4860 - DNA, 495 bp, Artificial Sequence; identical to SEQ ID NO: 2580
  Oligonucleotide

SEQ ID NO: 4861 - DNA, 495 bp, Artificial Sequence; identical to SEQ ID NO: 2581
  Oligonucleotide

SEQ ID NO: 4862 - DNA, 495 bp, Artificial Sequence; identical to SEQ ID NO: 2582
  Oligonucleotide

SEQ ID NO: 4863 - DNA, 495 bp, Artificial Sequence; identical to SEQ ID NO: 2583
  Oligonucleotide

SEQ ID NO: 4864 - DNA, 495 bp, Artificial Sequence; identical to SEQ ID NO: 2584
  Oligonucleotide

SEQ ID NO: 4865 - DNA, 495 bp, Artificial Sequence; identical to SEQ ID NO: 2585
  Oligonucleotide

SEQ ID NO: 4866 - DNA, 495 bp, Artificial Sequence; identical to SEQ ID NO: 2586
  Oligonucleotide

SEQ ID NO: 4867 - DNA, 495 bp, Artificial Sequence; identical to SEQ ID NO: 2587
  Oligonucleotide

SEQ ID NO: 4868 - DNA, 495 bp, Artificial Sequence; identical to SEQ ID NO: 2588
  Oligonucleotide

SEQ ID NO: 4869 - DNA, 495 bp, Artificial Sequence; identical to SEQ ID NO: 2589
  Oligonucleotide

SEQ ID NO: 4870 - DNA, 495 bp, Artificial Sequence; identical to SEQ ID NO: 2590
  Oligonucleotide

SEQ ID NO: 4871 - DNA, 495 bp, Artificial Sequence; identical to SEQ ID NO: 2591
  Oligonucleotide

SEQ ID NO: 4872 - DNA, 495 bp, Artificial Sequence; identical to SEQ ID NO: 2592
  Oligonucleotide

SEQ ID NO: 4873 - DNA, 495 bp, Artificial Sequence; identical to SEQ ID NO: 2593
  Oligonucleotide

SEQ ID NO: 4874 - DNA, 495 bp, Artificial Sequence; identical to SEQ ID NO: 2594
  Oligonucleotide

SEQ ID NO: 4875 - DNA, 495 bp, Artificial Sequence; identical to SEQ ID NO: 2595
  Oligonucleotide

SEQ ID NO: 4876 - DNA, 495 bp, Artificial Sequence; identical to SEQ ID NO: 2596
  Oligonucleotide

SEQ ID NO: 4877 - DNA, 495 bp, Artificial Sequence; identical to SEQ ID NO: 2597
  Oligonucleotide

SEQ ID NO: 4878 - DNA, 495 bp, Artificial Sequence; identical to SEQ ID NO: 2598
  Oligonucleotide

SEQ ID NO: 4879 - DNA, 495 bp, Artificial Sequence; identical to SEQ ID NO: 2599
  Oligonucleotide

SEQ ID NO: 4880 - DNA, 495 bp, Artificial Sequence; identical to SEQ ID NO: 2600
  Oligonucleotide

SEQ ID NO: 4881 - DNA, 495 bp, Artificial Sequence; identical to SEQ ID NO: 2601
  Oligonucleotide

SEQ ID NO: 4882 - DNA, 495 bp, Artificial Sequence; identical to SEQ ID NO: 2602
  Oligonucleotide

SEQ ID NO: 4883 - DNA, 495 bp, Artificial Sequence; identical to SEQ ID NO: 2603
  Oligonucleotide

SEQ ID NO: 4884 - DNA, 495 bp, Artificial Sequence; identical to SEQ ID NO: 2604
  Oligonucleotide

SEQ ID NO: 4885 - DNA, 495 bp, Artificial Sequence; identical to SEQ ID NO: 2605
  Oligonucleotide

SEQ ID NO: 4886 - DNA, 495 bp, Artificial Sequence; identical to SEQ ID NO: 2606
  Oligonucleotide

SEQ ID NO: 4887 - DNA, 495 bp, Artificial Sequence; identical to SEQ ID NO: 2607
  Oligonucleotide

SEQ ID NO: 4888 - DNA, 495 bp, Artificial Sequence; identical to SEQ ID NO: 2608
  Oligonucleotide

SEQ ID NO: 4889 - DNA, 495 bp, Artificial Sequence; identical to SEQ ID NO: 2609
  Oligonucleotide

SEQ ID NO: 4890 - DNA, 495 bp, Artificial Sequence; identical to SEQ ID NO: 2610
  Oligonucleotide

SEQ ID NO: 4891 - DNA, 495 bp, Artificial Sequence; identical to SEQ ID NO: 2611
  Oligonucleotide

SEQ ID NO: 4892 - DNA, 495 bp, Artificial Sequence; identical to SEQ ID NO: 2612
  Oligonucleotide

SEQ ID NO: 4893 - DNA, 495 bp, Artificial Sequence; identical to SEQ ID NO: 2613
  Oligonucleotide

SEQ ID NO: 4894 - DNA, 495 bp, Artificial Sequence; identical to SEQ ID NO: 2614
  Oligonucleotide

SEQ ID NO: 4895 - DNA, 495 bp, Artificial Sequence; identical to SEQ ID NO: 2615
  Oligonucleotide

SEQ ID NO: 4896 - DNA, 495 bp, Artificial Sequence; identical to SEQ ID NO: 2616
  Oligonucleotide

SEQ ID NO: 4897 - DNA, 495 bp, Artificial Sequence; identical to SEQ ID NO: 2617
  Oligonucleotide

SEQ ID NO: 4898 - DNA, 495 bp, Artificial Sequence; identical to SEQ ID NO: 2618
  Oligonucleotide

SEQ ID NO: 4899 - DNA, 495 bp, Artificial Sequence; identical to SEQ ID NO: 2619
  Oligonucleotide

SEQ ID NO: 4900 - DNA, 495 bp, Artificial Sequence; identical to SEQ ID NO: 2620
  Oligonucleotide

SEQ ID NO: 4901 - DNA, 495 bp, Artificial Sequence; identical to SEQ ID NO: 2621
  Oligonucleotide

SEQ ID NO: 4902 - DNA, 495 bp, Artificial Sequence; identical to SEQ ID NO: 2622
  Oligonucleotide

SEQ ID NO: 4903 - DNA, 495 bp, Artificial Sequence; identical to SEQ ID NO: 2623
  Oligonucleotide

SEQ ID NO: 4904 - DNA, 495 bp, Artificial Sequence; identical to SEQ ID NO: 2624
  Oligonucleotide

SEQ ID NO: 4905 - DNA, 495 bp, Artificial Sequence; identical to SEQ ID NO: 2625
  Oligonucleotide

SEQ ID NO: 4906 - DNA, 495 bp, Artificial Sequence; identical to SEQ ID NO: 2626
  Oligonucleotide

SEQ ID NO: 4907 - DNA, 495 bp, Artificial Sequence; identical to SEQ ID NO: 2627
  Oligonucleotide

SEQ ID NO: 4908 - DNA, 495 bp, Artificial Sequence; identical to SEQ ID NO: 2628
  Oligonucleotide

SEQ ID NO: 4909 - DNA, 495 bp, Artificial Sequence; identical to SEQ ID NO: 2629
  Oligonucleotide

SEQ ID NO: 4910 - DNA, 495 bp, Artificial Sequence; identical to SEQ ID NO: 2630
  Oligonucleotide

SEQ ID NO: 4911 - DNA, 495 bp, Artificial Sequence; identical to SEQ ID NO: 2631
  Oligonucleotide

SEQ ID NO: 4912 - DNA, 495 bp, Artificial Sequence; identical to SEQ ID NO: 2632
  Oligonucleotide

SEQ ID NO: 4913 - DNA, 495 bp, Artificial Sequence; identical to SEQ ID NO: 2633
  Oligonucleotide

SEQ ID NO: 4914 - DNA, 495 bp, Artificial Sequence; identical to SEQ ID NO: 2634
  Oligonucleotide

SEQ ID NO: 4915 - DNA, 495 bp, Artificial Sequence; identical to SEQ ID NO: 2635
  Oligonucleotide

SEQ ID NO: 4916 - DNA, 495 bp, Artificial Sequence; identical to SEQ ID NO: 2636
  Oligonucleotide

SEQ ID NO: 4917 - DNA, 495 bp, Artificial Sequence; identical to SEQ ID NO: 2637
  Oligonucleotide

SEQ ID NO: 4918 - DNA, 495 bp, Artificial Sequence; identical to SEQ ID NO: 2638
  Oligonucleotide

SEQ ID NO: 4919 - DNA, 495 bp, Artificial Sequence; identical to SEQ ID NO: 2639
  Oligonucleotide

SEQ ID NO: 4920 - DNA, 495 bp, Artificial Sequence; identical to SEQ ID NO: 2640
  Oligonucleotide

SEQ ID NO: 4921 - DNA, 495 bp, Artificial Sequence; identical to SEQ ID NO: 2641
  Oligonucleotide

SEQ ID NO: 4922 - DNA, 495 bp, Artificial Sequence; identical to SEQ ID NO: 2642
  Oligonucleotide

SEQ ID NO: 4923 - DNA, 495 bp, Artificial Sequence; identical to SEQ ID NO: 2643
  Oligonucleotide

SEQ ID NO: 4924 - DNA, 495 bp, Artificial Sequence; identical to SEQ ID NO: 2644
  Oligonucleotide

SEQ ID NO: 4925 - DNA, 495 bp, Artificial Sequence; identical to SEQ ID NO: 2645
  Oligonucleotide

SEQ ID NO: 4926 - DNA, 495 bp, Artificial Sequence; identical to SEQ ID NO: 2646
  Oligonucleotide

SEQ ID NO: 4927 - DNA, 495 bp, Artificial Sequence; identical to SEQ ID NO: 2647
  Oligonucleotide

SEQ ID NO: 4928 - DNA, 495 bp, Artificial Sequence; identical to SEQ ID NO: 2648
  Oligonucleotide

SEQ ID NO: 4929 - DNA, 495 bp, Artificial Sequence; identical to SEQ ID NO: 2649
  Oligonucleotide

SEQ ID NO: 4930 - DNA, 495 bp, Artificial Sequence; identical to SEQ ID NO: 2650
  Oligonucleotide

SEQ ID NO: 4931 - DNA, 495 bp, Artificial Sequence; identical to SEQ ID NO: 2651
  Oligonucleotide

SEQ ID NO: 4932 - DNA, 495 bp, Artificial Sequence; identical to SEQ ID NO: 2652
  Oligonucleotide

SEQ ID NO: 4933 - DNA, 495 bp, Artificial Sequence; identical to SEQ ID NO: 2653
  Oligonucleotide

SEQ ID NO: 4934 - DNA, 495 bp, Artificial Sequence; identical to SEQ ID NO: 2654
  Oligonucleotide

SEQ ID NO: 4935 - DNA, 495 bp, Artificial Sequence; identical to SEQ ID NO: 2655
  Oligonucleotide

SEQ ID NO: 4936 - DNA, 495 bp, Artificial Sequence; identical to SEQ ID NO: 2656
  Oligonucleotide

SEQ ID NO: 4937 - DNA, 495 bp, Artificial Sequence; identical to SEQ ID NO: 2657
  Oligonucleotide

SEQ ID NO: 4938 - DNA, 495 bp, Artificial Sequence; identical to SEQ ID NO: 2658
  Oligonucleotide

SEQ ID NO: 4939 - DNA, 495 bp, Artificial Sequence; identical to SEQ ID NO: 2659
  Oligonucleotide

SEQ ID NO: 4940 - DNA, 495 bp, Artificial Sequence; identical to SEQ ID NO: 2660
  Oligonucleotide

SEQ ID NO: 4941 - DNA, 495 bp, Artificial Sequence; identical to SEQ ID NO: 2661
  Oligonucleotide

SEQ ID NO: 4942 - DNA, 495 bp, Artificial Sequence; identical to SEQ ID NO: 2662
  Oligonucleotide

SEQ ID NO: 4943 - DNA, 495 bp, Artificial Sequence; identical to SEQ ID NO: 2663
  Oligonucleotide

SEQ ID NO: 4944 - DNA, 495 bp, Artificial Sequence; identical to SEQ ID NO: 2664
  Oligonucleotide

SEQ ID NO: 4945 - DNA, 495 bp, Artificial Sequence; identical to SEQ ID NO: 2665
  Oligonucleotide

SEQ ID NO: 4946 - DNA, 495 bp, Artificial Sequence; identical to SEQ ID NO: 2666
  Oligonucleotide

SEQ ID NO: 4947 - DNA, 495 bp, Artificial Sequence; identical to SEQ ID NO: 2667
  Oligonucleotide

SEQ ID NO: 4948 - DNA, 495 bp, Artificial Sequence; identical to SEQ ID NO: 2668
  Oligonucleotide

SEQ ID NO: 4949 - DNA, 495 bp, Artificial Sequence; identical to SEQ ID NO: 2669
  Oligonucleotide

SEQ ID NO: 4950 - DNA, 495 bp, Artificial Sequence; identical to SEQ ID NO: 2670
  Oligonucleotide

SEQ ID NO: 4951 - DNA, 448 bp, Artificial Sequence; identical to SEQ ID NO: 2671
  Oligonucleotide

SEQ ID NO: 4952 - DNA, 495 bp, Artificial Sequence; identical to SEQ ID NO: 2672
  Oligonucleotide

SEQ ID NO: 4953 - DNA, 495 bp, Artificial Sequence; identical to SEQ ID NO: 2673
  Oligonucleotide

SEQ ID NO: 4954 - DNA, 495 bp, Artificial Sequence; identical to SEQ ID NO: 2674
  Oligonucleotide

SEQ ID NO: 4955 - DNA, 495 bp, Artificial Sequence; identical to SEQ ID NO: 2675
  Oligonucleotide

SEQ ID NO: 4956 - DNA, 495 bp, Artificial Sequence; identical to SEQ ID NO: 2676
  Oligonucleotide

SEQ ID NO: 4957 - DNA, 495 bp, Artificial Sequence; identical to SEQ ID NO: 2677
  Oligonucleotide

SEQ ID NO: 4958 - DNA, 495 bp, Artificial Sequence; identical to SEQ ID NO: 2678
  Oligonucleotide

SEQ ID NO: 4959 - DNA, 495 bp, Artificial Sequence; identical to SEQ ID NO: 2679
  Oligonucleotide

SEQ ID NO: 4960 - DNA, 495 bp, Artificial Sequence; identical to SEQ ID NO: 2680
  Oligonucleotide

SEQ ID NO: 4961 - DNA, 495 bp, Artificial Sequence; identical to SEQ ID NO: 2681
  Oligonucleotide

SEQ ID NO: 4962 - DNA, 495 bp, Artificial Sequence; identical to SEQ ID NO: 2682
  Oligonucleotide

SEQ ID NO: 4963 - DNA, 495 bp, Artificial Sequence; identical to SEQ ID NO: 2683
  Oligonucleotide

SEQ ID NO: 4964 - DNA, 495 bp, Artificial Sequence; identical to SEQ ID NO: 2684
  Oligonucleotide

SEQ ID NO: 4965 - DNA, 495 bp, Artificial Sequence; identical to SEQ ID NO: 2685
  Oligonucleotide

SEQ ID NO: 4966 - DNA, 495 bp, Artificial Sequence; identical to SEQ ID NO: 2686
  Oligonucleotide

SEQ ID NO: 4967 - DNA, 495 bp, Artificial Sequence; identical to SEQ ID NO: 2687
  Oligonucleotide

SEQ ID NO: 4968 - DNA, 495 bp, Artificial Sequence; identical to SEQ ID NO: 2688
  Oligonucleotide

SEQ ID NO: 4969 - DNA, 495 bp, Artificial Sequence; identical to SEQ ID NO: 2689
  Oligonucleotide

SEQ ID NO: 4970 - DNA, 495 bp, Artificial Sequence; identical to SEQ ID NO: 2690
  Oligonucleotide

SEQ ID NO: 4971 - DNA, 495 bp, Artificial Sequence; identical to SEQ ID NO: 2691
  Oligonucleotide

SEQ ID NO: 4972 - DNA, 495 bp, Artificial Sequence; identical to SEQ ID NO: 2692
  Oligonucleotide

SEQ ID NO: 4973 - DNA, 495 bp, Artificial Sequence; identical to SEQ ID NO: 2693
  Oligonucleotide

SEQ ID NO: 4974 - DNA, 495 bp, Artificial Sequence; identical to SEQ ID NO: 2694
  Oligonucleotide

SEQ ID NO: 4975 - DNA, 495 bp, Artificial Sequence; identical to SEQ ID NO: 2695
  Oligonucleotide

SEQ ID NO: 4976 - DNA, 495 bp, Artificial Sequence; identical to SEQ ID NO: 2696
  Oligonucleotide

SEQ ID NO: 4977 - DNA, 495 bp, Artificial Sequence; identical to SEQ ID NO: 2697
  Oligonucleotide

SEQ ID NO: 4978 - DNA, 495 bp, Artificial Sequence; identical to SEQ ID NO: 2698
  Oligonucleotide

SEQ ID NO: 4979 - DNA, 495 bp, Artificial Sequence; identical to SEQ ID NO: 2699
  Oligonucleotide

SEQ ID NO: 4980 - DNA, 495 bp, Artificial Sequence; identical to SEQ ID NO: 2700
  Oligonucleotide

SEQ ID NO: 4981 - DNA, 495 bp, Artificial Sequence; identical to SEQ ID NO: 2701
  Oligonucleotide

SEQ ID NO: 4982 - DNA, 495 bp, Artificial Sequence; identical to SEQ ID NO: 2702
  Oligonucleotide

SEQ ID NO: 4983 - DNA, 495 bp, Artificial Sequence; identical to SEQ ID NO: 2703
  Oligonucleotide

SEQ ID NO: 4984 - DNA, 495 bp, Artificial Sequence; identical to SEQ ID NO: 2704
  Oligonucleotide

SEQ ID NO: 4985 - DNA, 495 bp, Artificial Sequence; identical to SEQ ID NO: 2705
  Oligonucleotide

SEQ ID NO: 4986 - DNA, 495 bp, Artificial Sequence; identical to SEQ ID NO: 2706
  Oligonucleotide

SEQ ID NO: 4987 - DNA, 495 bp, Artificial Sequence; identical to SEQ ID NO: 2707
  Oligonucleotide

SEQ ID NO: 4988 - DNA, 495 bp, Artificial Sequence; identical to SEQ ID NO: 2708
  Oligonucleotide

SEQ ID NO: 4989 - DNA, 495 bp, Artificial Sequence; identical to SEQ ID NO: 2709
  Oligonucleotide

SEQ ID NO: 4990 - DNA, 495 bp, Artificial Sequence; identical to SEQ ID NO: 2710
  Oligonucleotide

SEQ ID NO: 4991 - DNA, 495 bp, Artificial Sequence; identical to SEQ ID NO: 2711
  Oligonucleotide

SEQ ID NO: 4992 - DNA, 495 bp, Artificial Sequence; identical to SEQ ID NO: 2712
  Oligonucleotide

SEQ ID NO: 4993 - DNA, 495 bp, Artificial Sequence; identical to SEQ ID NO: 2713
  Oligonucleotide

SEQ ID NO: 4994 - DNA, 495 bp, Artificial Sequence; identical to SEQ ID NO: 2714
  Oligonucleotide

SEQ ID NO: 4995 - DNA, 495 bp, Artificial Sequence; identical to SEQ ID NO: 2715
  Oligonucleotide

SEQ ID NO: 4996 - DNA, 495 bp, Artificial Sequence; identical to SEQ ID NO: 2716
  Oligonucleotide

SEQ ID NO: 4997 - DNA, 495 bp, Artificial Sequence; identical to SEQ ID NO: 2717
  Oligonucleotide

SEQ ID NO: 4998 - DNA, 495 bp, Artificial Sequence; identical to SEQ ID NO: 2718
  Oligonucleotide

SEQ ID NO: 4999 - DNA, 495 bp, Artificial Sequence; identical to SEQ ID NO: 2719
  Oligonucleotide

SEQ ID NO: 5000 - DNA, 495 bp, Artificial Sequence; identical to SEQ ID NO: 2720
  Oligonucleotide

SEQ ID NO: 5001 - DNA, 495 bp, Artificial Sequence; identical to SEQ ID NO: 2721
  Oligonucleotide

SEQ ID NO: 5002 - DNA, 495 bp, Artificial Sequence; identical to SEQ ID NO: 2722
  Oligonucleotide

SEQ ID NO: 5003 - DNA, 495 bp, Artificial Sequence; identical to SEQ ID NO: 2723
  Oligonucleotide

SEQ ID NO: 5004 - DNA, 495 bp, Artificial Sequence; identical to SEQ ID NO: 2724
  Oligonucleotide

SEQ ID NO: 5005 - DNA, 495 bp, Artificial Sequence; identical to SEQ ID NO: 2725
  Oligonucleotide

SEQ ID NO: 5006 - DNA, 495 bp, Artificial Sequence; identical to SEQ ID NO: 2726
  Oligonucleotide

SEQ ID NO: 5007 - DNA, 495 bp, Artificial Sequence; identical to SEQ ID NO: 2727
  Oligonucleotide

SEQ ID NO: 5008 - DNA, 495 bp, Artificial Sequence; identical to SEQ ID NO: 2728
  Oligonucleotide

SEQ ID NO: 5009 - DNA, 495 bp, Artificial Sequence; identical to SEQ ID NO: 2729
  Oligonucleotide

SEQ ID NO: 5010 - DNA, 495 bp, Artificial Sequence; identical to SEQ ID NO: 2730
  Oligonucleotide

SEQ ID NO: 5011 - DNA, 495 bp, Artificial Sequence; identical to SEQ ID NO: 2731
  Oligonucleotide

SEQ ID NO: 5012 - DNA, 495 bp, Artificial Sequence; identical to SEQ ID NO: 2732
  Oligonucleotide

SEQ ID NO: 5013 - DNA, 495 bp, Artificial Sequence; identical to SEQ ID NO: 2733
  Oligonucleotide

SEQ ID NO: 5014 - DNA, 495 bp, Artificial Sequence; identical to SEQ ID NO: 2734
  Oligonucleotide

SEQ ID NO: 5015 - DNA, 495 bp, Artificial Sequence; identical to SEQ ID NO: 2735
  Oligonucleotide

SEQ ID NO: 5016 - DNA, 495 bp, Artificial Sequence; identical to SEQ ID NO: 2736
  Oligonucleotide

SEQ ID NO: 5017 - DNA, 495 bp, Artificial Sequence; identical to SEQ ID NO: 2737
  Oligonucleotide

SEQ ID NO: 5018 - DNA, 495 bp, Artificial Sequence; identical to SEQ ID NO: 2738
  Oligonucleotide

SEQ ID NO: 5019 - DNA, 495 bp, Artificial Sequence; identical to SEQ ID NO: 2739
  Oligonucleotide

SEQ ID NO: 5020 - DNA, 495 bp, Artificial Sequence; identical to SEQ ID NO: 2740
  Oligonucleotide

SEQ ID NO: 5021 - DNA, 495 bp, Artificial Sequence; identical to SEQ ID NO: 2741
  Oligonucleotide

SEQ ID NO: 5022 - DNA, 495 bp, Artificial Sequence; identical to SEQ ID NO: 2742
  Oligonucleotide

SEQ ID NO: 5023 - DNA, 495 bp, Artificial Sequence; identical to SEQ ID NO: 2743
  Oligonucleotide

SEQ ID NO: 5024 - DNA, 495 bp, Artificial Sequence; identical to SEQ ID NO: 2744
  Oligonucleotide

SEQ ID NO: 5025 - DNA, 495 bp, Artificial Sequence; identical to SEQ ID NO: 2745
  Oligonucleotide

SEQ ID NO: 5026 - DNA, 495 bp, Artificial Sequence; identical to SEQ ID NO: 2746
  Oligonucleotide

SEQ ID NO: 5027 - DNA, 495 bp, Artificial Sequence; identical to SEQ ID NO: 2747
  Oligonucleotide

SEQ ID NO: 5028 - DNA, 495 bp, Artificial Sequence; identical to SEQ ID NO: 2748
  Oligonucleotide

SEQ ID NO: 5029 - DNA, 495 bp, Artificial Sequence; identical to SEQ ID NO: 2749
  Oligonucleotide

SEQ ID NO: 5030 - DNA, 495 bp, Artificial Sequence; identical to SEQ ID NO: 2750
  Oligonucleotide

SEQ ID NO: 5031 - DNA, 495 bp, Artificial Sequence; identical to SEQ ID NO: 2751
  Oligonucleotide

SEQ ID NO: 5032 - DNA, 495 bp, Artificial Sequence; identical to SEQ ID NO: 2752
  Oligonucleotide

SEQ ID NO: 5033 - DNA, 495 bp, Artificial Sequence; identical to SEQ ID NO: 2753
  Oligonucleotide

SEQ ID NO: 5034 - DNA, 495 bp, Artificial Sequence; identical to SEQ ID NO: 2754
  Oligonucleotide

SEQ ID NO: 5035 - DNA, 495 bp, Artificial Sequence; identical to SEQ ID NO: 2755
  Oligonucleotide

SEQ ID NO: 5036 - DNA, 495 bp, Artificial Sequence; identical to SEQ ID NO: 2756
  Oligonucleotide

SEQ ID NO: 5037 - DNA, 495 bp, Artificial Sequence; identical to SEQ ID NO: 2757
  Oligonucleotide

SEQ ID NO: 5038 - DNA, 495 bp, Artificial Sequence; identical to SEQ ID NO: 2758
  Oligonucleotide

SEQ ID NO: 5039 - DNA, 495 bp, Artificial Sequence; identical to SEQ ID NO: 2759
  Oligonucleotide

SEQ ID NO: 5040 - DNA, 495 bp, Artificial Sequence; identical to SEQ ID NO: 2760
  Oligonucleotide

SEQ ID NO: 5041 - DNA, 495 bp, Artificial Sequence; identical to SEQ ID NO: 2761
  Oligonucleotide

SEQ ID NO: 5042 - DNA, 495 bp, Artificial Sequence; identical to SEQ ID NO: 2762
  Oligonucleotide

SEQ ID NO: 5043 - DNA, 495 bp, Artificial Sequence; identical to SEQ ID NO: 2763
  Oligonucleotide

SEQ ID NO: 5044 - DNA, 495 bp, Artificial Sequence; identical to SEQ ID NO: 2764
  Oligonucleotide

SEQ ID NO: 5045 - DNA, 495 bp, Artificial Sequence; identical to SEQ ID NO: 2765
  Oligonucleotide

SEQ ID NO: 5046 - DNA, 495 bp, Artificial Sequence; identical to SEQ ID NO: 2766
  Oligonucleotide

SEQ ID NO: 5047 - DNA, 495 bp, Artificial Sequence; identical to SEQ ID NO: 2767
  Oligonucleotide

SEQ ID NO: 5048 - DNA, 495 bp, Artificial Sequence; identical to SEQ ID NO: 2768
  Oligonucleotide

SEQ ID NO: 5049 - DNA, 495 bp, Artificial Sequence; identical to SEQ ID NO: 2769
  Oligonucleotide

SEQ ID NO: 5050 - DNA, 495 bp, Artificial Sequence; identical to SEQ ID NO: 2770
  Oligonucleotide

SEQ ID NO: 5051 - DNA, 495 bp, Artificial Sequence; identical to SEQ ID NO: 2771
  Oligonucleotide

SEQ ID NO: 5052 - DNA, 495 bp, Artificial Sequence; identical to SEQ ID NO: 2772
  Oligonucleotide

SEQ ID NO: 5053 - DNA, 495 bp, Artificial Sequence; identical to SEQ ID NO: 2773
  Oligonucleotide

SEQ ID NO: 5054 - DNA, 495 bp, Artificial Sequence; identical to SEQ ID NO: 2774
  Oligonucleotide

SEQ ID NO: 5055 - DNA, 495 bp, Artificial Sequence; identical to SEQ ID NO: 2775
  Oligonucleotide

SEQ ID NO: 5056 - DNA, 495 bp, Artificial Sequence; identical to SEQ ID NO: 2776
  Oligonucleotide

SEQ ID NO: 5057 - DNA, 495 bp, Artificial Sequence; identical to SEQ ID NO: 2777
  Oligonucleotide

SEQ ID NO: 5058 - DNA, 495 bp, Artificial Sequence; identical to SEQ ID NO: 2778
  Oligonucleotide

SEQ ID NO: 5059 - DNA, 495 bp, Artificial Sequence; identical to SEQ ID NO: 2779
  Oligonucleotide

SEQ ID NO: 5060 - DNA, 495 bp, Artificial Sequence; identical to SEQ ID NO: 2780
  Oligonucleotide

SEQ ID NO: 5061 - DNA, 495 bp, Artificial Sequence; identical to SEQ ID NO: 2781
  Oligonucleotide

SEQ ID NO: 5062 - DNA, 495 bp, Artificial Sequence; identical to SEQ ID NO: 2782
  Oligonucleotide

SEQ ID NO: 5063 - DNA, 495 bp, Artificial Sequence; identical to SEQ ID NO: 2783
  Oligonucleotide

SEQ ID NO: 5064 - DNA, 495 bp, Artificial Sequence; identical to SEQ ID NO: 2784
  Oligonucleotide

SEQ ID NO: 5065 - DNA, 495 bp, Artificial Sequence; identical to SEQ ID NO: 2785
  Oligonucleotide

SEQ ID NO: 5066 - DNA, 495 bp, Artificial Sequence; identical to SEQ ID NO: 2786
  Oligonucleotide

SEQ ID NO: 5067 - DNA, 495 bp, Artificial Sequence; identical to SEQ ID NO: 2787
  Oligonucleotide

SEQ ID NO: 5068 - DNA, 495 bp, Artificial Sequence; identical to SEQ ID NO: 2788
  Oligonucleotide

SEQ ID NO: 5069 - DNA, 495 bp, Artificial Sequence; identical to SEQ ID NO: 2789
  Oligonucleotide

SEQ ID NO: 5070 - DNA, 495 bp, Artificial Sequence; identical to SEQ ID NO: 2790
  Oligonucleotide

SEQ ID NO: 5071 - DNA, 495 bp, Artificial Sequence; identical to SEQ ID NO: 2791
  Oligonucleotide

SEQ ID NO: 5072 - DNA, 495 bp, Artificial Sequence; identical to SEQ ID NO: 2792
  Oligonucleotide

SEQ ID NO: 5073 - DNA, 495 bp, Artificial Sequence; identical to SEQ ID NO: 2793
  Oligonucleotide

SEQ ID NO: 5074 - DNA, 495 bp, Artificial Sequence; identical to SEQ ID NO: 2794
  Oligonucleotide

SEQ ID NO: 5075 - DNA, 448 bp, Artificial Sequence; identical to SEQ ID NO: 2795
  Oligonucleotide

SEQ ID NO: 5076 - DNA, 495 bp, Artificial Sequence; identical to SEQ ID NO: 2796
  Oligonucleotide

SEQ ID NO: 5077 - DNA, 495 bp, Artificial Sequence; identical to SEQ ID NO: 2797
  Oligonucleotide

SEQ ID NO: 5078 - DNA, 495 bp, Artificial Sequence; identical to SEQ ID NO: 2798
  Oligonucleotide

SEQ ID NO: 5079 - DNA, 495 bp, Artificial Sequence; identical to SEQ ID NO: 2799
  Oligonucleotide

SEQ ID NO: 5080 - DNA, 495 bp, Artificial Sequence; identical to SEQ ID NO: 2800
  Oligonucleotide

SEQ ID NO: 5081 - DNA, 495 bp, Artificial Sequence; identical to SEQ ID NO: 2801
  Oligonucleotide

SEQ ID NO: 5082 - DNA, 495 bp, Artificial Sequence; identical to SEQ ID NO: 2802
  Oligonucleotide

SEQ ID NO: 5083 - DNA, 495 bp, Artificial Sequence; identical to SEQ ID NO: 2803
  Oligonucleotide

SEQ ID NO: 5084 - DNA, 495 bp, Artificial Sequence; identical to SEQ ID NO: 2804
  Oligonucleotide

SEQ ID NO: 5085 - DNA, 495 bp, Artificial Sequence; identical to SEQ ID NO: 2805
  Oligonucleotide

SEQ ID NO: 5086 - DNA, 495 bp, Artificial Sequence; identical to SEQ ID NO: 2806
  Oligonucleotide

SEQ ID NO: 5087 - DNA, 495 bp, Artificial Sequence; identical to SEQ ID NO: 2807
  Oligonucleotide

SEQ ID NO: 5088 - DNA, 495 bp, Artificial Sequence; identical to SEQ ID NO: 2808
  Oligonucleotide

SEQ ID NO: 5089 - DNA, 495 bp, Artificial Sequence; identical to SEQ ID NO: 2809
  Oligonucleotide

SEQ ID NO: 5090 - DNA, 495 bp, Artificial Sequence; identical to SEQ ID NO: 2810
  Oligonucleotide

SEQ ID NO: 5091 - DNA, 495 bp, Artificial Sequence; identical to SEQ ID NO: 2811
  Oligonucleotide

SEQ ID NO: 5092 - DNA, 495 bp, Artificial Sequence; identical to SEQ ID NO: 2812
  Oligonucleotide

SEQ ID NO: 5093 - DNA, 495 bp, Artificial Sequence; identical to SEQ ID NO: 2813
  Oligonucleotide

SEQ ID NO: 5094 - DNA, 495 bp, Artificial Sequence; identical to SEQ ID NO: 2814
  Oligonucleotide

SEQ ID NO: 5095 - DNA, 495 bp, Artificial Sequence; identical to SEQ ID NO: 2815
  Oligonucleotide

SEQ ID NO: 5096 - DNA, 495 bp, Artificial Sequence; identical to SEQ ID NO: 2816
  Oligonucleotide

SEQ ID NO: 5097 - DNA, 495 bp, Artificial Sequence; identical to SEQ ID NO: 2817
  Oligonucleotide

SEQ ID NO: 5098 - DNA, 495 bp, Artificial Sequence; identical to SEQ ID NO: 2818
  Oligonucleotide

SEQ ID NO: 5099 - DNA, 495 bp, Artificial Sequence; identical to SEQ ID NO: 2819
  Oligonucleotide

SEQ ID NO: 5100 - DNA, 495 bp, Artificial Sequence; identical to SEQ ID NO: 2820
  Oligonucleotide

SEQ ID NO: 5101 - DNA, 495 bp, Artificial Sequence; identical to SEQ ID NO: 2821
  Oligonucleotide

SEQ ID NO: 5102 - DNA, 495 bp, Artificial Sequence; identical to SEQ ID NO: 2822
  Oligonucleotide

SEQ ID NO: 5103 - DNA, 495 bp, Artificial Sequence; identical to SEQ ID NO: 2823
  Oligonucleotide

SEQ ID NO: 5104 - DNA, 495 bp, Artificial Sequence; identical to SEQ ID NO: 2824
  Oligonucleotide

SEQ ID NO: 5105 - DNA, 495 bp, Artificial Sequence; identical to SEQ ID NO: 2825
  Oligonucleotide

SEQ ID NO: 5106 - DNA, 495 bp, Artificial Sequence; identical to SEQ ID NO: 2826
  Oligonucleotide

SEQ ID NO: 5107 - DNA, 495 bp, Artificial Sequence; identical to SEQ ID NO: 2827
  Oligonucleotide

SEQ ID NO: 5108 - DNA, 495 bp, Artificial Sequence; identical to SEQ ID NO: 2828
  Oligonucleotide

SEQ ID NO: 5109 - DNA, 495 bp, Artificial Sequence; identical to SEQ ID NO: 2829
  Oligonucleotide

SEQ ID NO: 5110 - DNA, 495 bp, Artificial Sequence; identical to SEQ ID NO: 2830
  Oligonucleotide

SEQ ID NO: 5111 - DNA, 495 bp, Artificial Sequence; identical to SEQ ID NO: 2831
  Oligonucleotide

SEQ ID NO: 5112 - DNA, 495 bp, Artificial Sequence; identical to SEQ ID NO: 2832
  Oligonucleotide

SEQ ID NO: 5113 - DNA, 495 bp, Artificial Sequence; identical to SEQ ID NO: 2833
  Oligonucleotide

SEQ ID NO: 5114 - DNA, 495 bp, Artificial Sequence; identical to SEQ ID NO: 2834
  Oligonucleotide

SEQ ID NO: 5115 - DNA, 495 bp, Artificial Sequence; identical to SEQ ID NO: 2835
  Oligonucleotide

SEQ ID NO: 5116 - DNA, 495 bp, Artificial Sequence; identical to SEQ ID NO: 2836
  Oligonucleotide

SEQ ID NO: 5117 - DNA, 495 bp, Artificial Sequence; identical to SEQ ID NO: 2837
  Oligonucleotide

SEQ ID NO: 5118 - DNA, 495 bp, Artificial Sequence; identical to SEQ ID NO: 2838
  Oligonucleotide

SEQ ID NO: 5119 - DNA, 495 bp, Artificial Sequence; identical to SEQ ID NO: 2839
  Oligonucleotide

SEQ ID NO: 5120 - DNA, 495 bp, Artificial Sequence; identical to SEQ ID NO: 2840
  Oligonucleotide

SEQ ID NO: 5121 - DNA, 495 bp, Artificial Sequence; identical to SEQ ID NO: 2841
  Oligonucleotide

SEQ ID NO: 5122 - DNA, 495 bp, Artificial Sequence; identical to SEQ ID NO: 2842
  Oligonucleotide

SEQ ID NO: 5123 - DNA, 495 bp, Artificial Sequence; identical to SEQ ID NO: 2843
  Oligonucleotide

SEQ ID NO: 5124 - DNA, 495 bp, Artificial Sequence; identical to SEQ ID NO: 2844
  Oligonucleotide

SEQ ID NO: 5125 - DNA, 495 bp, Artificial Sequence; identical to SEQ ID NO: 2845
  Oligonucleotide

SEQ ID NO: 5126 - DNA, 495 bp, Artificial Sequence; identical to SEQ ID NO: 2846
  Oligonucleotide

SEQ ID NO: 5127 - DNA, 495 bp, Artificial Sequence; identical to SEQ ID NO: 2847
  Oligonucleotide

SEQ ID NO: 5128 - DNA, 495 bp, Artificial Sequence; identical to SEQ ID NO: 2848
  Oligonucleotide

SEQ ID NO: 5129 - DNA, 495 bp, Artificial Sequence; identical to SEQ ID NO: 2849
  Oligonucleotide

SEQ ID NO: 5130 - DNA, 495 bp, Artificial Sequence; identical to SEQ ID NO: 2850
  Oligonucleotide

SEQ ID NO: 5131 - DNA, 495 bp, Artificial Sequence; identical to SEQ ID NO: 2851
  Oligonucleotide

SEQ ID NO: 5132 - DNA, 495 bp, Artificial Sequence; identical to SEQ ID NO: 2852
  Oligonucleotide

SEQ ID NO: 5133 - DNA, 495 bp, Artificial Sequence; identical to SEQ ID NO: 2853
  Oligonucleotide

SEQ ID NO: 5134 - DNA, 495 bp, Artificial Sequence; identical to SEQ ID NO: 2854
  Oligonucleotide

SEQ ID NO: 5135 - DNA, 495 bp, Artificial Sequence; identical to SEQ ID NO: 2855
  Oligonucleotide

SEQ ID NO: 5136 - DNA, 495 bp, Artificial Sequence; identical to SEQ ID NO: 2856
  Oligonucleotide

SEQ ID NO: 5137 - DNA, 495 bp, Artificial Sequence; identical to SEQ ID NO: 2857
  Oligonucleotide

SEQ ID NO: 5138 - DNA, 495 bp, Artificial Sequence; identical to SEQ ID NO: 2858
  Oligonucleotide

SEQ ID NO: 5139 - DNA, 495 bp, Artificial Sequence; identical to SEQ ID NO: 2859
  Oligonucleotide

SEQ ID NO: 5140 - DNA, 495 bp, Artificial Sequence; identical to SEQ ID NO: 2860
  Oligonucleotide

SEQ ID NO: 5141 - DNA, 495 bp, Artificial Sequence; identical to SEQ ID NO: 2861
  Oligonucleotide

SEQ ID NO: 5142 - DNA, 495 bp, Artificial Sequence; identical to SEQ ID NO: 2862
  Oligonucleotide

SEQ ID NO: 5143 - DNA, 495 bp, Artificial Sequence; identical to SEQ ID NO: 2863
  Oligonucleotide

SEQ ID NO: 5144 - DNA, 495 bp, Artificial Sequence; identical to SEQ ID NO: 2864
  Oligonucleotide

SEQ ID NO: 5145 - DNA, 495 bp, Artificial Sequence; identical to SEQ ID NO: 2865
  Oligonucleotide

SEQ ID NO: 5146 - DNA, 495 bp, Artificial Sequence; identical to SEQ ID NO: 2866
  Oligonucleotide

SEQ ID NO: 5147 - DNA, 495 bp, Artificial Sequence; identical to SEQ ID NO: 2867
  Oligonucleotide

SEQ ID NO: 5148 - DNA, 495 bp, Artificial Sequence; identical to SEQ ID NO: 2868
  Oligonucleotide

SEQ ID NO: 5149 - DNA, 495 bp, Artificial Sequence; identical to SEQ ID NO: 2869
  Oligonucleotide

SEQ ID NO: 5150 - DNA, 495 bp, Artificial Sequence; identical to SEQ ID NO: 2870
  Oligonucleotide

SEQ ID NO: 5151 - DNA, 495 bp, Artificial Sequence; identical to SEQ ID NO: 2871
  Oligonucleotide

SEQ ID NO: 5152 - DNA, 495 bp, Artificial Sequence; identical to SEQ ID NO: 2872
  Oligonucleotide

SEQ ID NO: 5153 - DNA, 495 bp, Artificial Sequence; identical to SEQ ID NO: 2873
  Oligonucleotide

SEQ ID NO: 5154 - DNA, 495 bp, Artificial Sequence; identical to SEQ ID NO: 2874
  Oligonucleotide

SEQ ID NO: 5155 - DNA, 495 bp, Artificial Sequence; identical to SEQ ID NO: 2875
  Oligonucleotide

SEQ ID NO: 5156 - DNA, 495 bp, Artificial Sequence; identical to SEQ ID NO: 2876
  Oligonucleotide

SEQ ID NO: 5157 - DNA, 495 bp, Artificial Sequence; identical to SEQ ID NO: 2877
  Oligonucleotide

SEQ ID NO: 5158 - DNA, 495 bp, Artificial Sequence; identical to SEQ ID NO: 2878
  Oligonucleotide

SEQ ID NO: 5159 - DNA, 495 bp, Artificial Sequence; identical to SEQ ID NO: 2879
  Oligonucleotide

SEQ ID NO: 5160 - DNA, 495 bp, Artificial Sequence; identical to SEQ ID NO: 2880
  Oligonucleotide

SEQ ID NO: 5161 - DNA, 495 bp, Artificial Sequence; identical to SEQ ID NO: 2881
  Oligonucleotide

SEQ ID NO: 5162 - DNA, 495 bp, Artificial Sequence; identical to SEQ ID NO: 2882
  Oligonucleotide

SEQ ID NO: 5163 - DNA, 495 bp, Artificial Sequence; identical to SEQ ID NO: 2883
  Oligonucleotide

SEQ ID NO: 5164 - DNA, 495 bp, Artificial Sequence; identical to SEQ ID NO: 2884
  Oligonucleotide

SEQ ID NO: 5165 - DNA, 495 bp, Artificial Sequence; identical to SEQ ID NO: 2885
  Oligonucleotide

SEQ ID NO: 5166 - DNA, 495 bp, Artificial Sequence; identical to SEQ ID NO: 2886
  Oligonucleotide

SEQ ID NO: 5167 - DNA, 495 bp, Artificial Sequence; identical to SEQ ID NO: 2887
  Oligonucleotide

SEQ ID NO: 5168 - DNA, 495 bp, Artificial Sequence; identical to SEQ ID NO: 2888
  Oligonucleotide

SEQ ID NO: 5169 - DNA, 495 bp, Artificial Sequence; identical to SEQ ID NO: 2889
  Oligonucleotide

SEQ ID NO: 5170 - DNA, 495 bp, Artificial Sequence; identical to SEQ ID NO: 2890
  Oligonucleotide

SEQ ID NO: 5171 - DNA, 495 bp, Artificial Sequence; identical to SEQ ID NO: 2891
  Oligonucleotide

SEQ ID NO: 5172 - DNA, 495 bp, Artificial Sequence; identical to SEQ ID NO: 2892
  Oligonucleotide

SEQ ID NO: 5173 - DNA, 495 bp, Artificial Sequence; identical to SEQ ID NO: 2893
  Oligonucleotide

SEQ ID NO: 5174 - DNA, 495 bp, Artificial Sequence; identical to SEQ ID NO: 2894
  Oligonucleotide

SEQ ID NO: 5175 - DNA, 495 bp, Artificial Sequence; identical to SEQ ID NO: 2895
  Oligonucleotide

SEQ ID NO: 5176 - DNA, 495 bp, Artificial Sequence; identical to SEQ ID NO: 2896
  Oligonucleotide

SEQ ID NO: 5177 - DNA, 495 bp, Artificial Sequence; identical to SEQ ID NO: 2897
  Oligonucleotide

SEQ ID NO: 5178 - DNA, 495 bp, Artificial Sequence; identical to SEQ ID NO: 2898
  Oligonucleotide

SEQ ID NO: 5179 - DNA, 495 bp, Artificial Sequence; identical to SEQ ID NO: 2899
  Oligonucleotide

SEQ ID NO: 5180 - DNA, 495 bp, Artificial Sequence; identical to SEQ ID NO: 2900
  Oligonucleotide

SEQ ID NO: 5181 - DNA, 495 bp, Artificial Sequence; identical to SEQ ID NO: 2901
  Oligonucleotide

SEQ ID NO: 5182 - DNA, 495 bp, Artificial Sequence; identical to SEQ ID NO: 2902
  Oligonucleotide

SEQ ID NO: 5183 - DNA, 495 bp, Artificial Sequence; identical to SEQ ID NO: 2903
  Oligonucleotide

SEQ ID NO: 5184 - DNA, 495 bp, Artificial Sequence; identical to SEQ ID NO: 2904
  Oligonucleotide

SEQ ID NO: 5185 - DNA, 495 bp, Artificial Sequence; identical to SEQ ID NO: 2905
  Oligonucleotide

SEQ ID NO: 5186 - DNA, 495 bp, Artificial Sequence; identical to SEQ ID NO: 2906
  Oligonucleotide

SEQ ID NO: 5187 - DNA, 495 bp, Artificial Sequence; identical to SEQ ID NO: 2907
  Oligonucleotide

SEQ ID NO: 5188 - DNA, 495 bp, Artificial Sequence; identical to SEQ ID NO: 2908
  Oligonucleotide

SEQ ID NO: 5189 - DNA, 495 bp, Artificial Sequence; identical to SEQ ID NO: 2909
  Oligonucleotide

SEQ ID NO: 5190 - DNA, 495 bp, Artificial Sequence; identical to SEQ ID NO: 2910
  Oligonucleotide

SEQ ID NO: 5191 - DNA, 495 bp, Artificial Sequence; identical to SEQ ID NO: 2911
  Oligonucleotide

SEQ ID NO: 5192 - DNA, 495 bp, Artificial Sequence; identical to SEQ ID NO: 2912
  Oligonucleotide

SEQ ID NO: 5193 - DNA, 495 bp, Artificial Sequence; identical to SEQ ID NO: 2913
  Oligonucleotide

SEQ ID NO: 5194 - DNA, 495 bp, Artificial Sequence; identical to SEQ ID NO: 2914
  Oligonucleotide

SEQ ID NO: 5195 - DNA, 495 bp, Artificial Sequence; identical to SEQ ID NO: 2915
  Oligonucleotide

SEQ ID NO: 5196 - DNA, 495 bp, Artificial Sequence; identical to SEQ ID NO: 2916
  Oligonucleotide

SEQ ID NO: 5197 - DNA, 495 bp, Artificial Sequence; identical to SEQ ID NO: 2917
  Oligonucleotide

SEQ ID NO: 5198 - DNA, 495 bp, Artificial Sequence; identical to SEQ ID NO: 2918
  Oligonucleotide

SEQ ID NO: 5199 - DNA, 448 bp, Artificial Sequence; identical to SEQ ID NO: 2919
  Oligonucleotide

SEQ ID NO: 5200 - DNA, 495 bp, Artificial Sequence; identical to SEQ ID NO: 2920
  Oligonucleotide

SEQ ID NO: 5201 - DNA, 49 bp, Artificial Sequence
  Oligonucleotide
gggctggcaagccacgtttggtgagcccccagggaagaagctgaagtgg

SEQ ID NO: 5202 - DNA, 49 bp, Artificial Sequence
  Oligonucleotide
gggctggcaagccacgtttggtgaggctccagggaatgggctggagttg

SEQ ID NO: 5203 - DNA, 49 bp, Artificial Sequence
  Oligonucleotide
gggctggcaagccacgtttggtgaggcttcaggacaggggttggtgtgg

SEQ ID NO: 5204 - DNA, 49 bp, Artificial Sequence
  Oligonucleotide
gggctggcaagccacgtttggtgaggcttcatgacaggggtgggtgtgg

SEQ ID NO: 5205 - DNA, 50 bp, Artificial Sequence
  Oligonucleotide
gggctggcaagccacgtttggtgcaagctccagggaagggactggagtgg

SEQ ID NO: 5206 - DNA, 54 bp, Artificial Sequence
  Oligonucleotide
gggctggcaagccacgtttggtgcaatgagactctagggaaggggctggaggga

SEQ ID NO: 5207 - DNA, 46 bp, Artificial Sequence
  Oligonucleotide
gggctggcaagccacgtttggtgcaccagggaagggcctggagtgg

SEQ ID NO: 5208 - DNA, 53 bp, Artificial Sequence
  Oligonucleotide
gggctggcaagccacgtttggtgcacgagtccacatgggaaggactggagtgg

SEQ ID NO: 5209 - DNA, 47 bp, Artificial Sequence
  Oligonucleotide
gggctggcaagccacgtttggtgcactagcccgcttccatgggctgt

SEQ ID NO: 5210 - DNA, 53 bp, Artificial Sequence
  Oligonucleotide
gggctggcaagccacgtttggtgcagcaggcttcacaacagggattgtggtgg

SEQ ID NO: 5211 - DNA, 53 bp, Artificial Sequence
  Oligonucleotide
gggctggcaagccacgtttggtgcagcaggcttcatgacagggattggtgtgg

SEQ ID NO: 5212 - DNA, 50 bp, Artificial Sequence
  Oligonucleotide
gggctggcaagccacgtttggtgcaggcccatggacaagggcttgaggaa

SEQ ID NO: 5213 - DNA, 50 bp, Artificial Sequence
  Oligonucleotide
gggctggcaagccacgtttggtgcaggctccagggaacagactggagtgg

SEQ ID NO: 5214 - DNA, 50 bp, Artificial Sequence
  Oligonucleotide
gggctggcaagccacgtttggtgcaggcttctgggaaagggctggagtgg

SEQ ID NO: 5215 - DNA, 50 bp, Artificial Sequence
  Oligonucleotide
gggctggcaagccacgtttggtgcagtccccatcgagaggccttgagtgg

SEQ ID NO: 5216 - DNA, 50 bp, Artificial Sequence
  Oligonucleotide
gggctggcaagccacgtttggtgcagtcccctggacaagggcttgagtgg

SEQ ID NO: 5217 - DNA, 53 bp, Artificial Sequence
  Oligonucleotide
gggctggcaagccacgtttggtgcatcaggctcctgggaaagggctggagtag

SEQ ID NO: 5218 - DNA, 51 bp, Artificial Sequence
  Oligonucleotide
gggctggcaagccacgtttggtgccagatgcccgggaaagaactggagtgg

SEQ ID NO: 5219 - DNA, 54 bp, Artificial Sequence
  Oligonucleotide
gggctggcaagccacgtttggtgccagcacgcttcacaacaggaattggtgtgg

SEQ ID NO: 5220 - DNA, 54 bp, Artificial Sequence
  Oligonucleotide
gggctggcaagccacgtttggtgccagcacgcttcacaacagggataggtgtgg

SEQ ID NO: 5221 - DNA, 51 bp, Artificial Sequence
  Oligonucleotide
gggctggcaagccacgtttggtgccaggctccaggaaagggtttggagtgg

SEQ ID NO: 5222 - DNA, 45 bp, Artificial Sequence
  Oligonucleotide
gggctggcaagccacgtttggtgcccagggaaggccctggagtgg

SEQ ID NO: 5223 - DNA, 45 bp, Artificial Sequence
  Oligonucleotide
gggctggcaagccacgtttggtgcccagggaagggcctggagtgg

SEQ ID NO: 5224 - DNA, 45 bp, Artificial Sequence
  Oligonucleotide
gggctggcaagccacgtttggtgcccagggaaggggctggagtgg

SEQ ID NO: 5225 - DNA, 46 bp, Artificial Sequence
  Oligonucleotide
gggctggcaagccacgtttggtgccccaggaaaggccctggagtgg

SEQ ID NO: 5226 - DNA, 46 bp, Artificial Sequence
  Oligonucleotide
gggctggcaagccacgtttggtgccccaggacaggggcttgagtgg

SEQ ID NO: 5227 - DNA, 46 bp, Artificial Sequence
  Oligonucleotide
gggctggcaagccacgtttggtgccccagggaagggactggagtgg

SEQ ID NO: 5228 - DNA, 46 bp, Artificial Sequence
  Oligonucleotide
gggctggcaagccacgtttggtgccccagggaaggggctggaatgg

SEQ ID NO: 5229 - DNA, 47 bp, Artificial Sequence
  Oligonucleotide
gggctggcaagccacgtttggtgcccccagggaagggaatggagtgg

SEQ ID NO: 5230 - DNA, 47 bp, Artificial Sequence
  Oligonucleotide
gggctggcaagccacgtttggtgccccccaggaagggactggagtga

SEQ ID NO: 5231 - DNA, 46 bp, Artificial Sequence
  Oligonucleotide
gggctggcaagccacgtttggtgcccccggacaagcgcttgagtgg

SEQ ID NO: 5232 - DNA, 49 bp, Artificial Sequence
  Oligonucleotide
gggctggcaagccacgtttggtgcccctctctgggagggaatggagtgg

SEQ ID NO: 5233 - DNA, 47 bp, Artificial Sequence
  Oligonucleotide
gggctggcaagccacgtttggtgcccgtgggcaacaggctggaatgg

SEQ ID NO: 5234 - DNA, 47 bp, Artificial Sequence
  Oligonucleotide
gggctggcaagccacgtttggtgccctcagcaaaggccctggagtgg

SEQ ID NO: 5235 - DNA, 46 bp, Artificial Sequence
  Oligonucleotide
gggctggcaagccacgtttggtgccgcaaggaagggactggagcga

SEQ ID NO: 5236 - DNA, 54 bp, Artificial Sequence
  Oligonucleotide
gggctggcaagccacgtttggtgccgccaagctacaggaaaaggtctggagtgg

SEQ ID NO: 5237 - DNA, 49 bp, Artificial Sequence
  Oligonucleotide
gggctggcaagccacgtttggtgccgccagtcctcagtcaagggagtgg

SEQ ID NO: 5238 - DNA, 43 bp, Artificial Sequence
  Oligonucleotide
gggctggcaagccacgtttggtgccgggaaggggctggagtgg

SEQ ID NO: 5239 - DNA, 51 bp, Artificial Sequence
  Oligonucleotide
gggctggcaagccacgtttggtgccgggcttcaagaaaggggctggaatgg

SEQ ID NO: 5240 - DNA, 44 bp, Artificial Sequence
  Oligonucleotide
gggctggcaagccacgtttggtgccggggaagggactggagcga

SEQ ID NO: 5241 - DNA, 61 bp, Artificial Sequence
  Oligonucleotide
gggctggcaagccacgtttggtgcctggatccaccatctcccatcaaaaggtcttcagtgt

SEQ ID NO: 5242 - DNA, 53 bp, Artificial Sequence
  Oligonucleotide
gggctggcaagccacgtttggtgcgccaggctccaagaaagggtttgtagtgg

SEQ ID NO: 5243 - DNA, 45 bp, Artificial Sequence
  Oligonucleotide
gggctggcaagccacgtttggtgcgccgggaagggactggagtgg

SEQ ID NO: 5244 - DNA, 46 bp, Artificial Sequence
  Oligonucleotide
gggctggcaagccacgtttggtgctccaggcaaggggctggagtgg

SEQ ID NO: 5245 - DNA, 46 bp, Artificial Sequence
  Oligonucleotide
gggctggcaagccacgtttggtgctccagggaagggcctggagtgg

SEQ ID NO: 5246 - DNA, 46 bp, Artificial Sequence
  Oligonucleotide
gggctggcaagccacgtttggtgctccagggaaggggctggagtgg

SEQ ID NO: 5247 - DNA, 46 bp, Artificial Sequence
  Oligonucleotide
gggctggcaagccacgtttggtgctccagggaaggggctggtgtgg

SEQ ID NO: 5248 - DNA, 46 bp, Artificial Sequence
  Oligonucleotide
gggctggcaagccacgtttggtgctccagggaagggtccggagtgg

SEQ ID NO: 5249 - DNA, 48 bp, Artificial Sequence
  Oligonucleotide
gggctggcaagccacgtttggtgctccccagggaagggactggagtga

SEQ ID NO: 5250 - DNA, 46 bp, Artificial Sequence
  Oligonucleotide
gggctggcaagccacgtttggtgctccggagaaggggctggagtgg

SEQ ID NO: 5251 - DNA, 46 bp, Artificial Sequence
  Oligonucleotide
gggctggcaagccacgtttggtgctccggggaagggtctggagtgg

SEQ ID NO: 5252 - DNA, 46 bp, Artificial Sequence
  Oligonucleotide
gggctggcaagccacgtttggtgctgcaggcaaggggctggagtga

SEQ ID NO: 5253 - DNA, 54 bp, Artificial Sequence
  Oligonucleotide
gggctggcaagccacgtttggtgctgcttgcccctagaagatggacaggagtgg

SEQ ID NO: 5254 - DNA, 43 bp, Artificial Sequence
  Oligonucleotide
gggctggcaagccacgtttggtgctgggaaggcgctggggcac

SEQ ID NO: 5255 - DNA, 46 bp, Artificial Sequence
  Oligonucleotide
gggctggcaagccacgtttggtgctgggggacagaggctggagtgg

SEQ ID NO: 5256 - DNA, 55 bp, Artificial Sequence
  Oligonucleotide
gggctggcaagccacgtttggtgctgtaggcactggatggaaagcacaggagtgg

SEQ ID NO: 5257 - DNA, 52 bp, Artificial Sequence
  Oligonucleotide
gggctggcaagccacgtttggtggacaggctcctggaaaagggcttgagtgg

SEQ ID NO: 5258 - DNA, 48 bp, Artificial Sequence
  Oligonucleotide
gggctggcaagccacgtttggtggatgcccgggaaaggcttggagtgg

SEQ ID NO: 5259 - DNA, 51 bp, Artificial Sequence
  Oligonucleotide
gggctggcaagccacgtttggtggcaggcttcatgacaggggtgggtgtag

SEQ ID NO: 5260 - DNA, 52 bp, Artificial Sequence
  Oligonucleotide
gggctggcaagccacgtttggtggccaggctccagggaagggactggaatat

SEQ ID NO: 5261 - DNA, 48 bp, Artificial Sequence
  Oligonucleotide
gggctggcaagccacgtttggtggcccccatgggaggtactggagtgg

SEQ ID NO: 5262 - DNA, 47 bp, Artificial Sequence
  Oligonucleotide
gggctggcaagccacgtttggtggcccccggacaaaggcttgagtgg

SEQ ID NO: 5263 - DNA, 47 bp, Artificial Sequence
  Oligonucleotide
gggctggcaagccacgtttggtggcccctggacaagggcttgagtgg

SEQ ID NO: 5264 - DNA, 45 bp, Artificial Sequence
  Oligonucleotide
gggctggcaagccacgtttggtggcccgggaaaggcctggagtgg

SEQ ID NO: 5265 - DNA, 47 bp, Artificial Sequence
  Oligonucleotide
gggctggcaagccacgtttggtggcctcagggaaggggctggaatgg

SEQ ID NO: 5266 - DNA, 47 bp, Artificial Sequence
  Oligonucleotide
gggctggcaagccacgtttggtggctccaggaaaggggctgcagtga

SEQ ID NO: 5267 - DNA, 47 bp, Artificial Sequence
  Oligonucleotide
gggctggcaagccacgtttggtggctccaggaaaggggctggagtgg

SEQ ID NO: 5268 - DNA, 47 bp, Artificial Sequence
  Oligonucleotide
gggctggcaagccacgtttggtggctccagggaaggggctggagtga

SEQ ID NO: 5269 - DNA, 47 bp, Artificial Sequence
  Oligonucleotide
gggctggcaagccacgtttggtggctccagggaagggtctgcagtgg

SEQ ID NO: 5270 - DNA, 47 bp, Artificial Sequence
  Oligonucleotide
gggctggcaagccacgtttggtggctctcagggaggggctgcaatgg

SEQ ID NO: 5271 - DNA, 47 bp, Artificial Sequence
  Oligonucleotide
gggctggcaagccacgtttggtggctggaggagaggggctggagtgg

SEQ ID NO: 5272 - DNA, 47 bp, Artificial Sequence
  Oligonucleotide
gggctggcaagccacgtttggtggcttccgggaaagggctggagtgg

SEQ ID NO: 5273 - DNA, 48 bp, Artificial Sequence
  Oligonucleotide
gggctggcaagccacgtttggtgggccactggacaagggcttgagtgg

SEQ ID NO: 5274 - DNA, 48 bp, Artificial Sequence
  Oligonucleotide
gggctggcaagccacgtttggtgggcccatgcacaagggcttgagtgg

SEQ ID NO: 5275 - DNA, 48 bp, Artificial Sequence
  Oligonucleotide
gggctggcaagccacgtttggtgggcccctggaaaagggcttgagtgg

SEQ ID NO: 5276 - DNA, 48 bp, Artificial Sequence
  Oligonucleotide
gggctggcaagccacgtttggtgggcccctggacaagggcttgaaagg

SEQ ID NO: 5277 - DNA, 48 bp, Artificial Sequence
  Oligonucleotide
gggctggcaagccacgtttggtgggctccagggaagggtctggagtgg

SEQ ID NO: 5278 - DNA, 48 bp, Artificial Sequence
  Oligonucleotide
gggctggcaagccacgtttggtgggctcgtggacaacgccttgagtgg

SEQ ID NO: 5279 - DNA, 47 bp, Artificial Sequence
  Oligonucleotide
gggctggcaagccacgtttggtggggccctggacaagggcatagtgg

SEQ ID NO: 5280 - DNA, 56 bp, Artificial Sequence
  Oligonucleotide
gggctggcaagccacgtttggtggtccagcaggattcatggcaagtgttggtgagg

SEQ ID NO: 5281 - DNA, 56 bp, Artificial Sequence
  Oligonucleotide
gggctggcaagccacgtttggtggtgtgacaggcccctggataagggtttgaatgg

SEQ ID NO: 5282 - DNA, 55 bp, Artificial Sequence
  Oligonucleotide
gggctggcaagccacgtttggtgtccagcaggcttcatgacagggatttgtgtgg

SEQ ID NO: 5283 - DNA, 45 bp, Artificial Sequence
  Oligonucleotide
gggctggcaagccacgtttggtgtcccgggaaggggctggaatgg

SEQ ID NO: 5284 - DNA, 47 bp, Artificial Sequence
  Oligonucleotide
gggctggcaagccacgtttggtgtctccaggcaaggggctggagtga

SEQ ID NO: 5285 - DNA, 53 bp, Artificial Sequence
  Oligonucleotide
gggctggcaagccacgtttggtgtgatagacccctggacagggctttgagtgg

SEQ ID NO: 5286 - DNA, 54 bp, Artificial Sequence
  Oligonucleotide
gggctggcaagccacgtttggtgtgtgacaaagccctggacaagggcatagtgg

SEQ ID NO: 5287 - DNA, 48 bp, Artificial Sequence
  Oligonucleotide
ccgggagctgcatgtgtcagaggcacctgaggagacggtgaccagggt

SEQ ID NO: 5288 - DNA, 51 bp, Artificial Sequence
  Oligonucleotide
ccgggagctgcatgtgtcagaggactcacctgaggagacagtgaccagggt

SEQ ID NO: 5289 - DNA, 60 bp, Artificial Sequence
  Oligonucleotide
ccgggagctgcatgtgtcagaggggaaagccatcttacctgaagagacggtgaccattgt

SEQ ID NO: 5290 - DNA, 51 bp, Artificial Sequence
  Oligonucleotide
ccgggagctgcatgtgtcagaggtcttacctgaggagacggtgaccgtggt

SEQ ID NO: 5291 - DNA, 43 bp, Artificial Sequence
  Oligonucleotide
ccgggagctgcatgtgtcagagggtggctgcggtctccagggc

SEQ ID NO: 5292 - DNA, 41 bp, Artificial Sequence
  Oligonucleotide
ccgggagctgcatgtgtcagaggggagacggtggccgggct

SEQ ID NO: 5293 - DNA, 47 bp, Artificial Sequence
  Oligonucleotide
ccgggagctgcatgtgtcagagggcctgacccctcagaagccagacc

SEQ ID NO: 5294 - DNA, 26 bp, Artificial Sequence
  Oligonucleotide
agcccccagggaagaagctgaagtgg

SEQ ID NO: 5295 - DNA, 26 bp, Artificial Sequence
  Oligonucleotide
aggctccagggaatgggctggagttg

SEQ ID NO: 5296 - DNA, 26 bp, Artificial Sequence
  Oligonucleotide
aggcttcaggacaggggttggtgtgg

SEQ ID NO: 5297 - DNA, 26 bp, Artificial Sequence
  Oligonucleotide
aggcttcatgacaggggtgggtgtgg

SEQ ID NO: 5298 - DNA, 27 bp, Artificial Sequence
  Oligonucleotide
caagctccagggaagggactggagtgg

SEQ ID NO: 5299 - DNA, 31 bp, Artificial Sequence
  Oligonucleotide
caatgagactctagggaaggggctggaggga

SEQ ID NO: 5300 - DNA, 23 bp, Artificial Sequence
  Oligonucleotide
caccagggaagggcctggagtgg

SEQ ID NO: 5301 - DNA, 30 bp, Artificial Sequence
  Oligonucleotide
cacgagtccacatgggaaggactggagtgg

SEQ ID NO: 5302 - DNA, 30 bp, Artificial Sequence
  Oligonucleotide
cagcaggcttcatgacagggattggtgtgg

SEQ ID NO: 5303 - DNA, 24 bp, Artificial Sequence
  Oligonucleotide
cactagcccgcttccatgggctgt

SEQ ID NO: 5304 - DNA, 30 bp, Artificial Sequence
  Oligonucleotide
cagcaggcttcacaacagggattgtggtgg

SEQ ID NO: 5305 - DNA, 30 bp, Artificial Sequence; identical to SEQ ID NO: 5302
  Oligonucleotide

SEQ ID NO: 5306 - DNA, 27 bp, Artificial Sequence
  Oligonucleotide
caggcccatggacaagggcttgaggaa

SEQ ID NO: 5307 - DNA, 27 bp, Artificial Sequence
  Oligonucleotide
caggctccagggaacagactggagtgg

SEQ ID NO: 5308 - DNA, 27 bp, Artificial Sequence
  Oligonucleotide
caggcttctgggaaagggctggagtgg

SEQ ID NO: 5309 - DNA, 27 bp, Artificial Sequence
  Oligonucleotide
cagtccccatcgagaggccttgagtgg

SEQ ID NO: 5310 - DNA, 27 bp, Artificial Sequence
  Oligonucleotide
cagtcccctggacaagggcttgagtgg

SEQ ID NO: 5311 - DNA, 30 bp, Artificial Sequence
  Oligonucleotide
catcaggctcctgggaaagggctggagtag

SEQ ID NO: 5312 - DNA, 28 bp, Artificial Sequence
  Oligonucleotide
ccagatgcccgggaaagaactggagtgg

SEQ ID NO: 5313 - DNA, 31 bp, Artificial Sequence
  Oligonucleotide
ccagcacgcttcacaacaggaattggtgtgg

SEQ ID NO: 5314 - DNA, 31 bp, Artificial Sequence
  Oligonucleotide
ccagcacgcttcacaacagggataggtgtgg

SEQ ID NO: 5315 - DNA, 28 bp, Artificial Sequence
  Oligonucleotide
ccaggctccaggaaagggtttggagtgg

SEQ ID NO: 5316 - DNA, 22 bp, Artificial Sequence
  Oligonucleotide
cccagggaaggccctggagtgg

SEQ ID NO: 5317 - DNA, 22 bp, Artificial Sequence
  Oligonucleotide
cccagggaaggggctggagtgg

SEQ ID NO: 5318 - DNA, 23 bp, Artificial Sequence
  Oligonucleotide
ccccaggaaaggccctggagtgg

SEQ ID NO: 5319 - DNA, 23 bp, Artificial Sequence
  Oligonucleotide
ccccaggacaggggcttgagtgg

SEQ ID NO: 5320 - DNA, 23 bp, Artificial Sequence
  Oligonucleotide
ccccagggaagggactggagtgg

SEQ ID NO: 5321 - DNA, 23 bp, Artificial Sequence
  Oligonucleotide
ccccagggaaggggctggaatgg

SEQ ID NO: 5322 - DNA, 24 bp, Artificial Sequence
  Oligonucleotide
cccccagggaagggaatggagtgg

SEQ ID NO: 5323 - DNA, 24 bp, Artificial Sequence
  Oligonucleotide
ccccccaggaagggactggagtga

SEQ ID NO: 5324 - DNA, 23 bp, Artificial Sequence
  Oligonucleotide
cccccggacaagcgcttgagtgg

SEQ ID NO: 5325 - DNA, 26 bp, Artificial Sequence
  Oligonucleotide
cccctctctgggagggaatggagtgg

SEQ ID NO: 5326 - DNA, 24 bp, Artificial Sequence
  Oligonucleotide
cccgtgggcaacaggctggaatgg

SEQ ID NO: 5327 - DNA, 24 bp, Artificial Sequence
  Oligonucleotide
ccctcagcaaaggccctggagtgg

SEQ ID NO: 5328 - DNA, 23 bp, Artificial Sequence
  Oligonucleotide
ccgcaaggaagggactggagcga

SEQ ID NO: 5329 - DNA, 31 bp, Artificial Sequence
  Oligonucleotide
ccgccaagctacaggaaaaggtctggagtgg

SEQ ID NO: 5330 - DNA, 26 bp, Artificial Sequence
  Oligonucleotide
ccgccagtcctcagtcaagggagtgg

SEQ ID NO: 5331 - DNA, 20 bp, Artificial Sequence
  Oligonucleotide
ccgggaaggggctggagtgg

SEQ ID NO: 5332 - DNA, 28 bp, Artificial Sequence
  Oligonucleotide
ccgggcttcaagaaaggggctggaatgg

SEQ ID NO: 5333 - DNA, 21 bp, Artificial Sequence
  Oligonucleotide
ccggggaagggactggagcga

SEQ ID NO: 5334 - DNA, 38 bp, Artificial Sequence
  Oligonucleotide
cctggatccaccatctcccatcaaaaggtcttcagtgt

SEQ ID NO: 5335 - DNA, 30 bp, Artificial Sequence
  Oligonucleotide
cgccaggctccaagaaagggtttgtagtgg

SEQ ID NO: 5336 - DNA, 22 bp, Artificial Sequence
  Oligonucleotide
cgccgggaagggactggagtgg

SEQ ID NO: 5337 - DNA, 23 bp, Artificial Sequence
  Oligonucleotide
ctccaggcaaggggctggagtgg

SEQ ID NO: 5338 - DNA, 23 bp, Artificial Sequence
  Oligonucleotide
ctccagggaagggcctggagtgg

SEQ ID NO: 5339 - DNA, 23 bp, Artificial Sequence
  Oligonucleotide
ctccagggaaggggctggagtgg

SEQ ID NO: 5340 - DNA, 23 bp, Artificial Sequence
  Oligonucleotide
ctccagggaaggggctggtgtgg

SEQ ID NO: 5341 - DNA, 23 bp, Artificial Sequence
  Oligonucleotide
ctccagggaagggtccggagtgg

SEQ ID NO: 5342 - DNA, 25 bp, Artificial Sequence
  Oligonucleotide
ctccccagggaagggactggagtga

SEQ ID NO: 5343 - DNA, 23 bp, Artificial Sequence
  Oligonucleotide
ctccggagaaggggctggagtgg

SEQ ID NO: 5344 - DNA, 23 bp, Artificial Sequence
  Oligonucleotide
ctccggggaagggtctggagtgg

SEQ ID NO: 5345 - DNA, 23 bp, Artificial Sequence
  Oligonucleotide
ctgcaggcaaggggctggagtga

SEQ ID NO: 5346 - DNA, 31 bp, Artificial Sequence
  Oligonucleotide
ctgcttgcccctagaagatggacaggagtgg

SEQ ID NO: 5347 - DNA, 20 bp, Artificial Sequence
  Oligonucleotide
ctgggaaggcgctggggcac

SEQ ID NO: 5348 - DNA, 23 bp, Artificial Sequence
  Oligonucleotide
ctgggggacagaggctggagtgg

SEQ ID NO: 5349 - DNA, 32 bp, Artificial Sequence
  Oligonucleotide
ctgtaggcactggatggaaagcacaggagtgg

SEQ ID NO: 5350 - DNA, 29 bp, Artificial Sequence
  Oligonucleotide
gacaggctcctggaaaagggcttgagtgg

SEQ ID NO: 5351 - DNA, 29 bp, Artificial Sequence
  Oligonucleotide
gatccgccagtcctcagtcaagggagtgg

SEQ ID NO: 5352 - DNA, 25 bp, Artificial Sequence
  Oligonucleotide
gatgcccgggaaaggcttggagtgg

SEQ ID NO: 5353 - DNA, 28 bp, Artificial Sequence
  Oligonucleotide
gcaggcttcatgacaggggtgggtgtag

SEQ ID NO: 5354 - DNA, 29 bp, Artificial Sequence
  Oligonucleotide
gccaggctccagggaagggactggaatat

SEQ ID NO: 5355 - DNA, 25 bp, Artificial Sequence
  Oligonucleotide
gcccccatgggaggtactggagtgg

SEQ ID NO: 5356 - DNA, 24 bp, Artificial Sequence
  Oligonucleotide
gcccccggacaaaggcttgagtgg

SEQ ID NO: 5357 - DNA, 24 bp, Artificial Sequence
  Oligonucleotide
gcccctggacaagggcttgagtgg

SEQ ID NO: 5358 - DNA, 22 bp, Artificial Sequence
  Oligonucleotide
gcccgggaaaggcctggagtgg

SEQ ID NO: 5359 - DNA, 24 bp, Artificial Sequence
  Oligonucleotide
gcctcagggaaggggctggaatgg

SEQ ID NO: 5360 - DNA, 24 bp, Artificial Sequence
  Oligonucleotide
gctccaggaaaggggctgcagtga

SEQ ID NO: 5361 - DNA, 24 bp, Artificial Sequence
  Oligonucleotide
gctccaggaaaggggctggagtgg

SEQ ID NO: 5362 - DNA, 24 bp, Artificial Sequence
  Oligonucleotide
gctccagggaagggtctgcagtgg

SEQ ID NO: 5363 - DNA, 24 bp, Artificial Sequence
  Oligonucleotide
gctctcagggaggggctgcaatgg

SEQ ID NO: 5364 - DNA, 24 bp, Artificial Sequence
  Oligonucleotide
gctggaggagaggggctggagtgg

SEQ ID NO: 5365 - DNA, 24 bp, Artificial Sequence
  Oligonucleotide
gcttccgggaaagggctggagtgg

SEQ ID NO: 5366 - DNA, 25 bp, Artificial Sequence
  Oligonucleotide
ggccactggacaagggcttgagtgg

SEQ ID NO: 5367 - DNA, 25 bp, Artificial Sequence
  Oligonucleotide
ggcccatgcacaagggcttgagtgg

SEQ ID NO: 5368 - DNA, 25 bp, Artificial Sequence
  Oligonucleotide
ggcccctggaaaagggcttgagtgg

SEQ ID NO: 5369 - DNA, 25 bp, Artificial Sequence
  Oligonucleotide
ggcccctggacaagggcttgaaagg

SEQ ID NO: 5370 - DNA, 25 bp, Artificial Sequence
  Oligonucleotide
ggctccagggaagggtctggagtgg

SEQ ID NO: 5371 - DNA, 25 bp, Artificial Sequence
  Oligonucleotide
ggctcgtggacaacgccttgagtgg

SEQ ID NO: 5372 - DNA, 24 bp, Artificial Sequence
  Oligonucleotide
gggccctggacaagggcatagtgg

SEQ ID NO: 5373 - DNA, 33 bp, Artificial Sequence
  Oligonucleotide
gtccagcaggattcatggcaagtgttggtgagg

SEQ ID NO: 5374 - DNA, 33 bp, Artificial Sequence
  Oligonucleotide
gtgtgacaggcccctggataagggtttgaatgg

SEQ ID NO: 5375 - DNA, 32 bp, Artificial Sequence
  Oligonucleotide
tccagcaggcttcatgacagggatttgtgtgg

SEQ ID NO: 5376 - DNA, 22 bp, Artificial Sequence
  Oligonucleotide
tcccgggaaggggctggaatgg

SEQ ID NO: 5377 - DNA, 24 bp, Artificial Sequence
  Oligonucleotide
tctccaggcaaggggctggagtga

SEQ ID NO: 5378 - DNA, 30 bp, Artificial Sequence
  Oligonucleotide
tgatagacccctggacagggctttgagtgg

SEQ ID NO: 5379 - DNA, 31 bp, Artificial Sequence
  Oligonucleotide
tgtgacaaagccctggacaagggcatagtgg

SEQ ID NO: 5380 - DNA, 25 bp, Artificial Sequence
  Oligonucleotide
cacctgaggagacggtgaccagggt

SEQ ID NO: 5381 - DNA, 28 bp, Artificial Sequence
  Oligonucleotide
actcacctgaggagacagtgaccagggt

SEQ ID NO: 5382 - DNA, 37 bp, Artificial Sequence
  Oligonucleotide
ggaaagccatcttacctgaagagacggtgaccattgt

SEQ ID NO: 5383 - DNA, 28 bp, Artificial Sequence
  Oligonucleotide
tcttacctgaggagacggtgaccgtggt

SEQ ID NO: 5384 - DNA, 20 bp, Artificial Sequence
  Oligonucleotide
gtggctgcggtctccagggc

SEQ ID NO: 5385 - DNA, 18 bp, Artificial Sequence
  Oligonucleotide
ggagacggtggccgggct

SEQ ID NO: 5386 - DNA, 24 bp, Artificial Sequence
  Oligonucleotide
gcctgacccctcagaagccagacc

SEQ ID NO: 5387 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncaaggtcaccgggagctgcatgtgtcagagg

SEQ ID NO: 5388 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngcataactccgggagctgcatgtgtcagagg

SEQ ID NO: 5389 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnctctgattccgggagctgcatgtgtcagagg

SEQ ID NO: 5390 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntacgtacgccgggagctgcatgtgtcagagg

SEQ ID NO: 5391 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntacgcgttccgggagctgcatgtgtcagagg

SEQ ID NO: 5392 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnctcagtgaccgggagctgcatgtgtcagagg

SEQ ID NO: 5393 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntctgatatccgggagctgcatgtgtcagagg

SEQ ID NO: 5394 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncatatgctccgggagctgcatgtgtcagagg

SEQ ID NO: 5395 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncgtaattaccgggagctgcatgtgtcagagg

SEQ ID NO: 5396 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnacgtactcccgggagctgcatgtgtcagagg

SEQ ID NO: 5397 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncttctaagccgggagctgcatgtgtcagagg

SEQ ID NO: 5398 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnactatgacccgggagctgcatgtgtcagagg

SEQ ID NO: 5399 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngacgttaaccgggagctgcatgtgtcagagg

SEQ ID NO: 5400 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnacaagataccgggagctgcatgtgtcagagg

SEQ ID NO: 5401 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngactaagaccgggagctgcatgtgtcagagg

SEQ ID NO: 5402 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngtgtctacccgggagctgcatgtgtcagagg

SEQ ID NO: 5403 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnttcactagccgggagctgcatgtgtcagagg

SEQ ID NO: 5404 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnaatcggatccgggagctgcatgtgtcagagg

SEQ ID NO: 5405 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnagtaccgaccgggagctgcatgtgtcagagg

SEQ ID NO: 5406 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnttgcctcaccgggagctgcatgtgtcagagg

SEQ ID NO: 5407 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntcgttagcccgggagctgcatgtgtcagagg

SEQ ID NO: 5408 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntatagttcccgggagctgcatgtgtcagagg

SEQ ID NO: 5409 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntggcgtatccgggagctgcatgtgtcagagg

SEQ ID NO: 5410 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntggacatgccgggagctgcatgtgtcagagg

SEQ ID NO: 5411 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnaggttgctccgggagctgcatgtgtcagagg

SEQ ID NO: 5412 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnatatgctgccgggagctgcatgtgtcagagg

SEQ ID NO: 5413 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngtacagtgccgggagctgcatgtgtcagagg

SEQ ID NO: 5414 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnatccatggccgggagctgcatgtgtcagagg

SEQ ID NO: 5415 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntgatgcgaccgggagctgcatgtgtcagagg

SEQ ID NO: 5416 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngtagcagtccgggagctgcatgtgtcagagg

SEQ ID NO: 5417 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnggatcatcccgggagctgcatgtgtcagagg

SEQ ID NO: 5418 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngtgaacgtccgggagctgcatgtgtcagagg

SEQ ID NO: 5419 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnattaagcgccgggagctgcatgtgtcagagg

SEQ ID NO: 5420 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntattggcgccgggagctgcatgtgtcagagg

SEQ ID NO: 5421 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncgattacaccgggagctgcatgtgtcagagg

SEQ ID NO: 5422 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntgtcatcgccgggagctgcatgtgtcagagg

SEQ ID NO: 5423 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntatcaagtccgggagctgcatgtgtcagagg

SEQ ID NO: 5424 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnaggcttgaccgggagctgcatgtgtcagagg

SEQ ID NO: 5425 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngataaccaccgggagctgcatgtgtcagagg

SEQ ID NO: 5426 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnaatcctgcccgggagctgcatgtgtcagagg

SEQ ID NO: 5427 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngttatatcccgggagctgcatgtgtcagagg

SEQ ID NO: 5428 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnacacacgtccgggagctgcatgtgtcagagg

SEQ ID NO: 5429 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnatacgactccgggagctgcatgtgtcagagg

SEQ ID NO: 5430 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnatcttcgtccgggagctgcatgtgtcagagg

SEQ ID NO: 5431 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnacatgtatccgggagctgcatgtgtcagagg

SEQ ID NO: 5432 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntccacagtccgggagctgcatgtgtcagagg

SEQ ID NO: 5433 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncagtctgtccgggagctgcatgtgtcagagg

SEQ ID NO: 5434 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntccatgtgccgggagctgcatgtgtcagagg

SEQ ID NO: 5435 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntcactgcaccgggagctgcatgtgtcagagg

SEQ ID NO: 5436 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnatggtcaaccgggagctgcatgtgtcagagg

SEQ ID NO: 5437 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncaagtcacccgggagctgcatgtgtcagagg

SEQ ID NO: 5438 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntagacggaccgggagctgcatgtgtcagagg

SEQ ID NO: 5439 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncagctcttccgggagctgcatgtgtcagagg

SEQ ID NO: 5440 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngagcgataccgggagctgcatgtgtcagagg

SEQ ID NO: 5441 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnctcgagaaccgggagctgcatgtgtcagagg

SEQ ID NO: 5442 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnatgacaccccgggagctgcatgtgtcagagg

SEQ ID NO: 5443 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncttcacgaccgggagctgcatgtgtcagagg

SEQ ID NO: 5444 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnctataaggccgggagctgcatgtgtcagagg

SEQ ID NO: 5445 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncgtagagtccgggagctgcatgtgtcagagg

SEQ ID NO: 5446 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnatagatacccgggagctgcatgtgtcagagg

SEQ ID NO: 5447 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntcgtcgatccgggagctgcatgtgtcagagg

SEQ ID NO: 5448 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntaagaatcccgggagctgcatgtgtcagagg

SEQ ID NO: 5449 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnaatgacagccgggagctgcatgtgtcagagg

SEQ ID NO: 5450 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnagctagtgccgggagctgcatgtgtcagagg

SEQ ID NO: 5451 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntgagacctccgggagctgcatgtgtcagagg

SEQ ID NO: 5452 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnagcgtaatccgggagctgcatgtgtcagagg

SEQ ID NO: 5453 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntaaccaagccgggagctgcatgtgtcagagg

SEQ ID NO: 5454 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngatggcttccgggagctgcatgtgtcagagg

SEQ ID NO: 5455 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngcatctgaccgggagctgcatgtgtcagagg

SEQ ID NO: 5456 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnttccggtaccgggagctgcatgtgtcagagg

SEQ ID NO: 5457 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngacactctccgggagctgcatgtgtcagagg

SEQ ID NO: 5458 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnttaagcatccgggagctgcatgtgtcagagg

SEQ ID NO: 5459 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntgctacacccgggagctgcatgtgtcagagg

SEQ ID NO: 5460 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntcagcttgccgggagctgcatgtgtcagagg

SEQ ID NO: 5461 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncatgtagaccgggagctgcatgtgtcagagg

SEQ ID NO: 5462 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnttcggaacccgggagctgcatgtgtcagagg

SEQ ID NO: 5463 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngcaattcgccgggagctgcatgtgtcagagg

SEQ ID NO: 5464 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncaagaggtccgggagctgcatgtgtcagagg

SEQ ID NO: 5465 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntcgattaaccgggagctgcatgtgtcagagg

SEQ ID NO: 5466 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngaatggacccgggagctgcatgtgtcagagg

SEQ ID NO: 5467 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnagaatcagccgggagctgcatgtgtcagagg

SEQ ID NO: 5468 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnaactgccaccgggagctgcatgtgtcagagg

SEQ ID NO: 5469 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnaagtaacgccgggagctgcatgtgtcagagg

SEQ ID NO: 5470 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnactcaatgccgggagctgcatgtgtcagagg

SEQ ID NO: 5471 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncctagtagccgggagctgcatgtgtcagagg

SEQ ID NO: 5472 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnctgacgttccgggagctgcatgtgtcagagg

SEQ ID NO: 5473 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntgcagacaccgggagctgcatgtgtcagagg

SEQ ID NO: 5474 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnagttgaccccgggagctgcatgtgtcagagg

SEQ ID NO: 5475 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngtctcctaccgggagctgcatgtgtcagagg

SEQ ID NO: 5476 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnctgcaatcccgggagctgcatgtgtcagagg

SEQ ID NO: 5477 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnntgagcgaaccgggagctgcatgtgtcagagg

SEQ ID NO: 5478 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnttggactgccgggagctgcatgtgtcagagg

SEQ ID NO: 5479 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnagcaatccccgggagctgcatgtgtcagagg

SEQ ID NO: 5480 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnncgaactacccgggagctgcatgtgtcagagg

SEQ ID NO: 5481 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnnttaatggcccgggagctgcatgtgtcagagg

SEQ ID NO: 5482 - DNA, 103 bp, Artificial Sequence
  Oligonucleotide
  misc_feature (67)..(72): n = A,T,C or G
aatgatacggcgaccaccgagatctacaccggtctcggcattcctgctgaaccgctcttccgatctnnnnnngcttagtaccgggagctgcatgtgtcagagg

SEQ ID NO: 5483 - DNA, 94 bp, Artificial Sequence
  Oligonucleotide
  misc_feature (66)..(71): n = A,T,C or G
caagcagaagacggcatacgagatacactctttccctacacgacgctcttccgatctcaaggtcannnnnngggctggcaagccacgtttggtg

SEQ ID NO: 5484 - DNA, 94 bp, Artificial Sequence
  Oligonucleotide
  misc_feature (66)..(71): n = A,T,C or G
caagcagaagacggcatacgagatacactctttccctacacgacgctcttccgatctgcataactnnnnnngggctggcaagccacgtttggtg

SEQ ID NO: 5485 - DNA, 94 bp, Artificial Sequence
  Oligonucleotide
  misc_feature (66)..(71): n = A,T,C or G
caagcagaagacggcatacgagatacactctttccctacacgacgctcttccgatctctctgattnnnnnngggctggcaagccacgtttggtg

SEQ ID NO: 5486 - DNA, 94 bp, Artificial Sequence
  Oligonucleotide
  misc_feature (66)..(71): n = A,T,C or G
caagcagaagacggcatacgagatacactctttccctacacgacgctcttccgatcttacgtacgnnnnnngggctggcaagccacgtttggtg

SEQ ID NO: 5487 - DNA, 94 bp, Artificial Sequence
  Oligonucleotide
  misc_feature (66)..(71): n = A,T,C or G
caagcagaagacggcatacgagatacactctttccctacacgacgctcttccgatcttacgcgttnnnnnngggctggcaagccacgtttggtg

SEQ ID NO: 5488 - DNA, 94 bp, Artificial Sequence
  Oligonucleotide
  misc_feature (66)..(71): n = A,T,C or G
caagcagaagacggcatacgagatacactctttccctacacgacgctcttccgatctctcagtgannnnnngggctggcaagccacgtttggtg

SEQ ID NO: 5489 - DNA, 94 bp, Artificial Sequence
  Oligonucleotide
  misc_feature (66)..(71): n = A,T,C or G
caagcagaagacggcatacgagatacactctttccctacacgacgctcttccgatcttctgatatnnnnnngggctggcaagccacgtttggtg

SEQ ID NO: 5490 - DNA, 94 bp, Artificial Sequence
  Oligonucleotide
  misc_feature (66)..(71): n = A,T,C or G
caagcagaagacggcatacgagatacactctttccctacacgacgctcttccgatctcatatgctnnnnnngggctggcaagccacgtttggtg

SEQ ID NO: 5491 - DNA, 94 bp, Artificial Sequence
  Oligonucleotide
  misc_feature (66)..(71): n = A,T,C or G
caagcagaagacggcatacgagatacactctttccctacacgacgctcttccgatctcgtaattannnnnngggctggcaagccacgtttggtg

SEQ ID NO: 5492 - DNA, 94 bp, Artificial Sequence
  Oligonucleotide
  misc_feature (66)..(71): n = A,T,C or G
caagcagaagacggcatacgagatacactctttccctacacgacgctcttccgatctacgtactcnnnnnngggctggcaagccacgtttggtg

SEQ ID NO: 5493 - DNA, 94 bp, Artificial Sequence
  Oligonucleotide
  misc_feature (66)..(71): n = A,T,C or G
caagcagaagacggcatacgagatacactctttccctacacgacgctcttccgatctcttctaagnnnnnngggctggcaagccacgtttggtg

SEQ ID NO: 5494 - DNA, 94 bp, Artificial Sequence
  Oligonucleotide
  misc_feature (66)..(71): n = A,T,C or G
caagcagaagacggcatacgagatacactctttccctacacgacgctcttccgatctactatgacnnnnnngggctggcaagccacgtttggtg

SEQ ID NO: 5495 - DNA, 94 bp, Artificial Sequence
  Oligonucleotide
  misc_feature (66)..(71): n = A,T,C or G
caagcagaagacggcatacgagatacactctttccctacacgacgctcttccgatctgacgttaannnnnngggctggcaagccacgtttggtg

SEQ ID NO: 5496 - DNA, 94 bp, Artificial Sequence
  Oligonucleotide
  misc_feature (66)..(71): n = A,T,C or G
caagcagaagacggcatacgagatacactctttccctacacgacgctcttccgatctacaagatannnnnngggctggcaagccacgtttggtg

SEQ ID NO: 5497 - DNA, 94 bp, Artificial Sequence
  Oligonucleotide
  misc_feature (66)..(71): n = A,T,C or G
caagcagaagacggcatacgagatacactctttccctacacgacgctcttccgatctgactaagannnnnngggctggcaagccacgtttggtg

SEQ ID NO: 5498 - DNA, 94 bp, Artificial Sequence
  Oligonucleotide
  misc_feature (66)..(71): n = A,T,C or G
caagcagaagacggcatacgagatacactctttccctacacgacgctcttccgatctgtgtctacnnnnnngggctggcaagccacgtttggtg

SEQ ID NO: 5499 - DNA, 94 bp, Artificial Sequence
  Oligonucleotide
  misc_feature (66)..(71): n = A,T,C or G
caagcagaagacggcatacgagatacactctttccctacacgacgctcttccgatctttcactagnnnnnngggctggcaagccacgtttggtg

SEQ ID NO: 5500 - DNA, 94 bp, Artificial Sequence
  Oligonucleotide
  misc_feature (66)..(71): n = A,T,C or G
caagcagaagacggcatacgagatacactctttccctacacgacgctcttccgatctaatcggatnnnnnngggctggcaagccacgtttggtg

SEQ ID NO: 5501 - DNA, 94 bp, Artificial Sequence
  Oligonucleotide
  misc_feature (66)..(71): n = A,T,C or G
caagcagaagacggcatacgagatacactctttccctacacgacgctcttccgatctagtaccgannnnnngggctggcaagccacgtttggtg

SEQ ID NO: 5502 - DNA, 94 bp, Artificial Sequence
  Oligonucleotide
  misc_feature (66)..(71): n = A,T,C or G
caagcagaagacggcatacgagatacactctttccctacacgacgctcttccgatctttgcctcannnnnngggctggcaagccacgtttggtg

SEQ ID NO: 5503 - DNA, 94 bp, Artificial Sequence
  Oligonucleotide
  misc_feature (66)..(71): n = A,T,C or G
caagcagaagacggcatacgagatacactctttccctacacgacgctcttccgatcttcgttagcnnnnnngggctggcaagccacgtttggtg

SEQ ID NO: 5504 - DNA, 94 bp, Artificial Sequence
  Oligonucleotide
  misc_feature (66)..(71): n = A,T,C or G
caagcagaagacggcatacgagatacactctttccctacacgacgctcttccgatcttatagttcnnnnnngggctggcaagccacgtttggtg

SEQ ID NO: 5505 - DNA, 94 bp, Artificial Sequence
  Oligonucleotide
  misc_feature (66)..(71): n = A,T,C or G
caagcagaagacggcatacgagatacactctttccctacacgacgctcttccgatcttggcgtatnnnnnngggctggcaagccacgtttggtg

SEQ ID NO: 5506 - DNA, 94 bp, Artificial Sequence
  Oligonucleotide
  misc_feature (66)..(71): n = A,T,C or G
caagcagaagacggcatacgagatacactctttccctacacgacgctcttccgatcttggacatgnnnnnngggctggcaagccacgtttggtg

SEQ ID NO: 5507 - DNA, 94 bp, Artificial Sequence
  Oligonucleotide
  misc_feature (66)..(71): n = A,T,C or G
caagcagaagacggcatacgagatacactctttccctacacgacgctcttccgatctaggttgctnnnnnngggctggcaagccacgtttggtg

SEQ ID NO: 5508 - DNA, 94 bp, Artificial Sequence
  Oligonucleotide
  misc_feature (66)..(71): n = A,T,C or G
caagcagaagacggcatacgagatacactctttccctacacgacgctcttccgatctatatgctgnnnnnngggctggcaagccacgtttggtg

SEQ ID NO: 5509 - DNA, 94 bp, Artificial Sequence
  Oligonucleotide
  misc_feature (66)..(71): n = A,T,C or G
caagcagaagacggcatacgagatacactctttccctacacgacgctcttccgatctgtacagtgnnnnnngggctggcaagccacgtttggtg

SEQ ID NO: 5510 - DNA, 94 bp, Artificial Sequence
  Oligonucleotide
  misc_feature (66)..(71): n = A,T,C or G
caagcagaagacggcatacgagatacactctttccctacacgacgctcttccgatctatccatggnnnnnngggctggcaagccacgtttggtg

SEQ ID NO: 5511 - DNA, 94 bp, Artificial Sequence
  Oligonucleotide
  misc_feature (66)..(71): n = A,T,C or G
caagcagaagacggcatacgagatacactctttccctacacgacgctcttccgatcttgatgcgannnnnngggctggcaagccacgtttggtg

SEQ ID NO: 5512 - DNA, 94 bp, Artificial Sequence
  Oligonucleotide
  misc_feature (66)..(71): n = A,T,C or G
caagcagaagacggcatacgagatacactctttccctacacgacgctcttccgatctgtagcagtnnnnnngggctggcaagccacgtttggtg

SEQ ID NO: 5513 - DNA, 94 bp, Artificial Sequence
  Oligonucleotide
  misc_feature (66)..(71): n = A,T,C or G
caagcagaagacggcatacgagatacactctttccctacacgacgctcttccgatctggatcatcnnnnnngggctggcaagccacgtttggtg

SEQ ID NO: 5514 - DNA, 94 bp, Artificial Sequence
  Oligonucleotide
  misc_feature (66)..(71): n = A,T,C or G
caagcagaagacggcatacgagatacactctttccctacacgacgctcttccgatctgtgaacgtnnnnnngggctggcaagccacgtttggtg

SEQ ID NO: 5515 - DNA, 94 bp, Artificial Sequence
  Oligonucleotide
  misc_feature (66)..(71): n = A,T,C or G
caagcagaagacggcatacgagatacactctttccctacacgacgctcttccgatctattaagcgnnnnnngggctggcaagccacgtttggtg

SEQ ID NO: 5516 - DNA, 94 bp, Artificial Sequence
  Oligonucleotide
  misc_feature (66)..(71): n = A,T,C or G
caagcagaagacggcatacgagatacactctttccctacacgacgctcttccgatcttattggcgnnnnnngggctggcaagccacgtttggtg

SEQ ID NO: 5517 - DNA, 94 bp, Artificial Sequence
  Oligonucleotide
  misc_feature (66)..(71): n = A,T,C or G
caagcagaagacggcatacgagatacactctttccctacacgacgctcttccgatctcgattacannnnnngggctggcaagccacgtttggtg

SEQ ID NO: 5518 - DNA, 94 bp, Artificial Sequence
  Oligonucleotide
  misc_feature (66)..(71): n = A,T,C or G
caagcagaagacggcatacgagatacactctttccctacacgacgctcttccgatcttgtcatcgnnnnnngggctggcaagccacgtttggtg

SEQ ID NO: 5519 - DNA, 94 bp, Artificial Sequence
  Oligonucleotide
  misc_feature (66)..(71): n = A,T,C or G
caagcagaagacggcatacgagatacactctttccctacacgacgctcttccgatcttatcaagtnnnnnngggctggcaagccacgtttggtg

SEQ ID NO: 5520 - DNA, 94 bp, Artificial Sequence
  Oligonucleotide
  misc_feature (66)..(71): n = A,T,C or G
caagcagaagacggcatacgagatacactctttccctacacgacgctcttccgatctaggcttgannnnnngggctggcaagccacgtttggtg

SEQ ID NO: 5521 - DNA, 94 bp, Artificial Sequence
  Oligonucleotide
  misc_feature (66)..(71): n = A,T,C or G
caagcagaagacggcatacgagatacactctttccctacacgacgctcttccgatctgataaccannnnnngggctggcaagccacgtttggtg

SEQ ID NO: 5522 - DNA, 94 bp, Artificial Sequence
  Oligonucleotide
  misc_feature (66)..(71): n = A,T,C or G
caagcagaagacggcatacgagatacactctttccctacacgacgctcttccgatctaatcctgcnnnnnngggctggcaagccacgtttggtg

SEQ ID NO: 5523 - DNA, 94 bp, Artificial Sequence
  Oligonucleotide
  misc_feature (66)..(71): n = A,T,C or G
caagcagaagacggcatacgagatacactctttccctacacgacgctcttccgatctgttatatcnnnnnngggctggcaagccacgtttggtg

SEQ ID NO: 5524 - DNA, 94 bp, Artificial Sequence
  Oligonucleotide
  misc_feature (66)..(71): n = A,T,C or G
caagcagaagacggcatacgagatacactctttccctacacgacgctcttccgatctacacacgtnnnnnngggctggcaagccacgtttggtg

SEQ ID NO: 5525 - DNA, 94 bp, Artificial Sequence
  Oligonucleotide
  misc_feature (66)..(71): n = A,T,C or G
caagcagaagacggcatacgagatacactctttccctacacgacgctcttccgatctatacgactnnnnnngggctggcaagccacgtttggtg

SEQ ID NO: 5526 - DNA, 94 bp, Artificial Sequence
  Oligonucleotide
  misc_feature (66)..(71): n = A,T,C or G
caagcagaagacggcatacgagatacactctttccctacacgacgctcttccgatctatcttcgtnnnnnngggctggcaagccacgtttggtg

SEQ ID NO: 5527 - DNA, 94 bp, Artificial Sequence
  Oligonucleotide
  misc_feature (66)..(71): n = A,T,C or G
caagcagaagacggcatacgagatacactctttccctacacgacgctcttccgatctacatgtatnnnnnngggctggcaagccacgtttggtg

SEQ ID NO: 5528 - DNA, 94 bp, Artificial Sequence
  Oligonucleotide
  misc_feature (66)..(71): n = A,T,C or G
caagcagaagacggcatacgagatacactctttccctacacgacgctcttccgatcttccacagtnnnnnngggctggcaagccacgtttggtg

SEQ ID NO: 5529 - DNA, 94 bp, Artificial Sequence
  Oligonucleotide
  misc_feature (66)..(71): n = A,T,C or G
caagcagaagacggcatacgagatacactctttccctacacgacgctcttccgatctcagtctgtnnnnnngggctggcaagccacgtttggtg

SEQ ID NO: 5530 - DNA, 94 bp, Artificial Sequence
  Oligonucleotide
  misc_feature (66)..(71): n = A,T,C or G
caagcagaagacggcatacgagatacactctttccctacacgacgctcttccgatcttccatgtgnnnnnngggctggcaagccacgtttggtg

SEQ ID NO: 5531 - DNA, 94 bp, Artificial Sequence
  Oligonucleotide
  misc_feature (66)..(71): n = A,T,C or G
caagcagaagacggcatacgagatacactctttccctacacgacgctcttccgatcttcactgcannnnnngggctggcaagccacgtttggtg

SEQ ID NO: 5532 - DNA, 94 bp, Artificial Sequence
  Oligonucleotide
  misc_feature (66)..(71): n = A,T,C or G
caagcagaagacggcatacgagatacactctttccctacacgacgctcttccgatctatggtcaannnnnngggctggcaagccacgtttggtg

SEQ ID NO: 5533 - DNA, 94 bp, Artificial Sequence
  Oligonucleotide
  misc_feature (66)..(71): n = A,T,C or G
caagcagaagacggcatacgagatacactctttccctacacgacgctcttccgatctcaagtcacnnnnnngggctggcaagccacgtttggtg

SEQ ID NO: 5534 - DNA, 94 bp, Artificial Sequence
  Oligonucleotide
  misc_feature (66)..(71): n = A,T,C or G
caagcagaagacggcatacgagatacactctttccctacacgacgctcttccgatcttagacggannnnnngggctggcaagccacgtttggtg

SEQ ID NO: 5535 - DNA, 94 bp, Artificial Sequence
  Oligonucleotide
  misc_feature (66)..(71): n = A,T,C or G
caagcagaagacggcatacgagatacactctttccctacacgacgctcttccgatctcagctcttnnnnnngggctggcaagccacgtttggtg

SEQ ID NO: 5536 - DNA, 94 bp, Artificial Sequence
  Oligonucleotide
  misc_feature (66)..(71): n = A,T,C or G
caagcagaagacggcatacgagatacactctttccctacacgacgctcttccgatctgagcgatannnnnngggctggcaagccacgtttggtg

SEQ ID NO: 5537 - DNA, 94 bp, Artificial Sequence
  Oligonucleotide
  misc_feature (66)..(71): n = A,T,C or G
caagcagaagacggcatacgagatacactctttccctacacgacgctcttccgatctctcgagaannnnnngggctggcaagccacgtttggtg

SEQ ID NO: 5538 - DNA, 94 bp, Artificial Sequence
  Oligonucleotide
  misc_feature (66)..(71): n = A,T,C or G
caagcagaagacggcatacgagatacactctttccctacacgacgctcttccgatctatgacaccnnnnnngggctggcaagccacgtttggtg

SEQ ID NO: 5539 - DNA, 94 bp, Artificial Sequence
  Oligonucleotide
  misc_feature (66)..(71): n = A,T,C or G
caagcagaagacggcatacgagatacactctttccctacacgacgctcttccgatctcttcacgannnnnngggctggcaagccacgtttggtg

SEQ ID NO: 5540 - DNA, 94 bp, Artificial Sequence
  Oligonucleotide
  misc_feature (66)..(71): n = A,T,C or G
caagcagaagacggcatacgagatacactctttccctacacgacgctcttccgatctctataaggnnnnnngggctggcaagccacgtttggtg

SEQ ID NO: 5541 - DNA, 94 bp, Artificial Sequence
  Oligonucleotide
  misc_feature (66)..(71): n = A,T,C or G
caagcagaagacggcatacgagatacactctttccctacacgacgctcttccgatctcgtagagtnnnnnngggctggcaagccacgtttggtg

SEQ ID NO: 5542 - DNA, 94 bp, Artificial Sequence
  Oligonucleotide
  misc_feature (66)..(71): n = A,T,C or G
caagcagaagacggcatacgagatacactctttccctacacgacgctcttccgatctatagatacnnnnnngggctggcaagccacgtttggtg

SEQ ID NO: 5543 - DNA, 94 bp, Artificial Sequence
  Oligonucleotide
  misc_feature (66)..(71): n = A,T,C or G
caagcagaagacggcatacgagatacactctttccctacacgacgctcttccgatcttcgtcgatnnnnnngggctggcaagccacgtttggtg

SEQ ID NO: 5544 - DNA, 94 bp, Artificial Sequence
  Oligonucleotide
  misc_feature (66)..(71): n = A,T,C or G
caagcagaagacggcatacgagatacactctttccctacacgacgctcttccgatcttaagaatcnnnnnngggctggcaagccacgtttggtg

SEQ ID NO: 5545 - DNA, 94 bp, Artificial Sequence
  Oligonucleotide
  misc_feature (66)..(71): n = A,T,C or G
caagcagaagacggcatacgagatacactctttccctacacgacgctcttccgatctaatgacagnnnnnngggctggcaagccacgtttggtg

SEQ ID NO: 5546 - DNA, 94 bp, Artificial Sequence
  Oligonucleotide
  misc_feature (66)..(71): n = A,T,C or G
caagcagaagacggcatacgagatacactctttccctacacgacgctcttccgatctagctagtgnnnnnngggctggcaagccacgtttggtg

SEQ ID NO: 5547 - DNA, 94 bp, Artificial Sequence
  Oligonucleotide
  misc_feature (66)..(71): n = A,T,C or G
caagcagaagacggcatacgagatacactctttccctacacgacgctcttccgatcttgagacctnnnnnngggctggcaagccacgtttggtg

SEQ ID NO: 5548 - DNA, 94 bp, Artificial Sequence
  Oligonucleotide
  misc_feature (66)..(71): n = A,T,C or G
caagcagaagacggcatacgagatacactctttccctacacgacgctcttccgatctagcgtaatnnnnnngggctggcaagccacgtttggtg

SEQ ID NO: 5549 - DNA, 94 bp, Artificial Sequence
  Oligonucleotide
  misc_feature (66)..(71): n = A,T,C or G
caagcagaagacggcatacgagatacactctttccctacacgacgctcttccgatcttaaccaagnnnnnngggctggcaagccacgtttggtg

SEQ ID NO: 5550 - DNA, 94 bp, Artificial Sequence
  Oligonucleotide
  misc_feature (66)..(71): n = A,T,C or G
caagcagaagacggcatacgagatacactctttccctacacgacgctcttccgatctgatggcttnnnnnngggctggcaagccacgtttggtg

SEQ ID NO: 5551 - DNA, 94 bp, Artificial Sequence
  Oligonucleotide
  misc_feature (66)..(71): n = A,T,C or G
caagcagaagacggcatacgagatacactctttccctacacgacgctcttccgatctgcatctgannnnnngggctggcaagccacgtttggtg

SEQ ID NO: 5552 - DNA, 94 bp, Artificial Sequence
  Oligonucleotide
  misc_feature (66)..(71): n = A,T,C or G
caagcagaagacggcatacgagatacactctttccctacacgacgctcttccgatctttccggtannnnnngggctggcaagccacgtttggtg

SEQ ID NO: 5553 - DNA, 94 bp, Artificial Sequence
  Oligonucleotide
  misc_feature (66)..(71): n = A,T,C or G
caagcagaagacggcatacgagatacactctttccctacacgacgctcttccgatctgacactctnnnnnngggctggcaagccacgtttggtg

SEQ ID NO: 5554 - DNA, 94 bp, Artificial Sequence
  Oligonucleotide
  misc_feature (66)..(71): n = A,T,C or G
caagcagaagacggcatacgagatacactctttccctacacgacgctcttccgatctttaagcatnnnnnngggctggcaagccacgtttggtg

SEQ ID NO: 5555 - DNA, 94 bp, Artificial Sequence
  Oligonucleotide
  misc_feature (66)..(71): n = A,T,C or G
caagcagaagacggcatacgagatacactctttccctacacgacgctcttccgatcttgctacacnnnnnngggctggcaagccacgtttggtg

SEQ ID NO: 5556 - DNA, 94 bp, Artificial Sequence
  Oligonucleotide
  misc_feature (66)..(71): n = A,T,C or G
caagcagaagacggcatacgagatacactctttccctacacgacgctcttccgatcttcagcttgnnnnnngggctggcaagccacgtttggtg

SEQ ID NO: 5557 - DNA, 94 bp, Artificial Sequence
  Oligonucleotide
  misc_feature (66)..(71): n = A,T,C or G
caagcagaagacggcatacgagatacactctttccctacacgacgctcttccgatctcatgtagannnnnngggctggcaagccacgtttggtg

SEQ ID NO: 5558 - DNA, 94 bp, Artificial Sequence
  Oligonucleotide
  misc_feature (66)..(71): n = A,T,C or G
caagcagaagacggcatacgagatacactctttccctacacgacgctcttccgatctttcggaacnnnnnngggctggcaagccacgtttggtg

SEQ ID NO: 5559 - DNA, 94 bp, Artificial Sequence
  Oligonucleotide
  misc_feature (66)..(71): n = A,T,C or G
caagcagaagacggcatacgagatacactctttccctacacgacgctcttccgatctgcaattcgnnnnnngggctggcaagccacgtttggtg

SEQ ID NO: 5560 - DNA, 94 bp, Artificial Sequence
  Oligonucleotide
  misc_feature (66)..(71): n = A,T,C or G
caagcagaagacggcatacgagatacactctttccctacacgacgctcttccgatctcaagaggtnnnnnngggctggcaagccacgtttggtg

SEQ ID NO: 5561 - DNA, 94 bp, Artificial Sequence
  Oligonucleotide
  misc_feature (66)..(71): n = A,T,C or G
caagcagaagacggcatacgagatacactctttccctacacgacgctcttccgatcttcgattaannnnnngggctggcaagccacgtttggtg

SEQ ID NO: 5562 - DNA, 94 bp, Artificial Sequence
  Oligonucleotide
  misc_feature (66)..(71): n = A,T,C or G
caagcagaagacggcatacgagatacactctttccctacacgacgctcttccgatctgaatggacnnnnnngggctggcaagccacgtttggtg

SEQ ID NO: 5563 - DNA, 94 bp, Artificial Sequence
  Oligonucleotide
  misc_feature (66)..(71): n = A,T,C or G
caagcagaagacggcatacgagatacactctttccctacacgacgctcttccgatctagaatcagnnnnnngggctggcaagccacgtttggtg

SEQ ID NO: 5564 - DNA, 94 bp, Artificial Sequence
  Oligonucleotide
  misc_feature (66)..(71): n = A,T,C or G
caagcagaagacggcatacgagatacactctttccctacacgacgctcttccgatctaactgccannnnnngggctggcaagccacgtttggtg

SEQ ID NO: 5565 - DNA, 94 bp, Artificial Sequence
  Oligonucleotide
  misc_feature (66)..(71): n = A,T,C or G
caagcagaagacggcatacgagatacactctttccctacacgacgctcttccgatctaagtaacgnnnnnngggctggcaagccacgtttggtg

SEQ ID NO: 5566 - DNA, 94 bp, Artificial Sequence
  Oligonucleotide
  misc_feature (66)..(71): n = A,T,C or G
caagcagaagacggcatacgagatacactctttccctacacgacgctcttccgatctactcaatgnnnnnngggctggcaagccacgtttggtg

SEQ ID NO: 5567 - DNA, 94 bp, Artificial Sequence
  Oligonucleotide
  misc_feature (66)..(71): n = A,T,C or G
caagcagaagacggcatacgagatacactctttccctacacgacgctcttccgatctcctagtagnnnnnngggctggcaagccacgtttggtg

SEQ ID NO: 5568 - DNA, 94 bp, Artificial Sequence
  Oligonucleotide
  misc_feature (66)..(71): n = A,T,C or G
caagcagaagacggcatacgagatacactctttccctacacgacgctcttccgatctctgacgttnnnnnngggctggcaagccacgtttggtg

SEQ ID NO: 5569 - DNA, 94 bp, Artificial Sequence
  Oligonucleotide
  misc_feature (66)..(71): n = A,T,C or G
caagcagaagacggcatacgagatacactctttccctacacgacgctcttccgatcttgcagacannnnnngggctggcaagccacgtttggtg

SEQ ID NO: 5570 - DNA, 94 bp, Artificial Sequence
  Oligonucleotide
  misc_feature (66)..(71): n = A,T,C or G
caagcagaagacggcatacgagatacactctttccctacacgacgctcttccgatctagttgaccnnnnnngggctggcaagccacgtttggtg

SEQ ID NO: 5571 - DNA, 94 bp, Artificial Sequence
  Oligonucleotide
  misc_feature (66)..(71): n = A,T,C or G
caagcagaagacggcatacgagatacactctttccctacacgacgctcttccgatctgtctcctannnnnngggctggcaagccacgtttggtg

SEQ ID NO: 5572 - DNA, 94 bp, Artificial Sequence
  Oligonucleotide
  misc_feature (66)..(71): n = A,T,C or G
caagcagaagacggcatacgagatacactctttccctacacgacgctcttccgatctctgcaatcnnnnnngggctggcaagccacgtttggtg

SEQ ID NO: 5573 - DNA, 94 bp, Artificial Sequence
  Oligonucleotide
  misc_feature (66)..(71): n = A,T,C or G
caagcagaagacggcatacgagatacactctttccctacacgacgctcttccgatcttgagcgaannnnnngggctggcaagccacgtttggtg

SEQ ID NO: 5574 - DNA, 94 bp, Artificial Sequence
  Oligonucleotide
  misc_feature (66)..(71): n = A,T,C or G
caagcagaagacggcatacgagatacactctttccctacacgacgctcttccgatctttggactgnnnnnngggctggcaagccacgtttggtg

SEQ ID NO: 5575 - DNA, 94 bp, Artificial Sequence
  Oligonucleotide
  misc_feature (66)..(71): n = A,T,C or G
caagcagaagacggcatacgagatacactctttccctacacgacgctcttccgatctagcaatccnnnnnngggctggcaagccacgtttggtg

SEQ ID NO: 5576 - DNA, 94 bp, Artificial Sequence
  Oligonucleotide
  misc_feature (66)..(71): n = A,T,C or G
caagcagaagacggcatacgagatacactctttccctacacgacgctcttccgatctcgaactacnnnnnngggctggcaagccacgtttggtg

SEQ ID NO: 5577 - DNA, 94 bp, Artificial Sequence
  Oligonucleotide
  misc_feature (66)..(71): n = A,T,C or G
caagcagaagacggcatacgagatacactctttccctacacgacgctcttccgatctttaatggcnnnnnngggctggcaagccacgtttggtg

SEQ ID NO: 5578 - DNA, 94 bp, Artificial Sequence
  Oligonucleotide
  misc_feature (66)..(71): n = A,T,C or G
caagcagaagacggcatacgagatacactctttccctacacgacgctcttccgatctgcttagtannnnnngggctggcaagccacgtttggtg

SEQ ID NO: 5579 - DNA, 42 bp, Artificial Sequence
  TRBV25-1_RN2v3
ggagatctttcctctgagtcaacagtctccagaataraggac

SEQ ID NO: 5580 - DNA, 36 bp, Artificial Sequence
  TRBV12-1_RN2v3
ggattgattctcagcacagatgcctgatgtratcat

SEQ ID NO: 5581 - DNA, 38 bp, Artificial Sequence
  TRBV12-5_RN2v3
gattctcagcagagatgcctgatgcaactttargccac

SEQ ID NO: 5582 - DNA, 47 bp, Artificial Sequence
  TRBV2_RN2v3
  misc_feature (43)..(43): n = uracil
aagtctgaaatattcgatgatcaattctcagttgaaaggccrngatg

SEQ ID NO: 5583 - DNA, 32 bp, Artificial Sequence
  TRBV16_RN2v3
agctaagtgcctcccaaattcaccctrgtagc

SEQ ID NO: 5584 - DNA, 31 bp, Artificial Sequence
  TRBV5-1_RN2v3
cgattctcagggcgccagttctctaractct

SEQ ID NO: 5585 - DNA, 35 bp, Artificial Sequence
  TRBV14_RN2v3
  misc_feature (31)..(31): n = uracil
tcttagctgaaaggactggagggacgtatrnctac

SEQ ID NO: 5586 - DNA, 38 bp, Artificial Sequence
  TRBV12-4_RN2v3
gaggatcgattctcagctaagatgcctaatgcratcat

SEQ ID NO: 5587 - DNA, 35 bp, Artificial Sequence
  TRBV28_RN2v3
tcctgaggggtacagtgtctctagagagaragaag

SEQ ID NO: 5588 - DNA, 40 bp, Artificial Sequence
  TRBV27_RN2v3
gatgttcctgaagggtacaaagtctctcgaaaagragaag

SEQ ID NO: 5589 - DNA, 36 bp, Artificial Sequence
  TRBV5-4_RN2v3
ctcctagattctcaggtctccagttccctarattat

SEQ ID NO: 5590 - DNA, 30 bp, Artificial Sequence
  TRBV7-1_RN2v3
cgtgatcggttctctgcacagaggtrctga

SEQ ID NO: 5591 - DNA, 31 bp, Artificial Sequence
  TRBV19_RN2v3
gctgaagggtacagcgtctctcgggragaag

SEQ ID NO: 5592 - DNA, 31 bp, Artificial Sequence
  TRBV5-3_RN2v3
cgattctcagggcgccagttccatgractgt

SEQ ID NO: 5593 - DNA, 39 bp, Artificial Sequence
  TRBV9_RN2v3
caacagttccctgacttgcactctgaactaaacrctgag

SEQ ID NO: 5594 - DNA, 39 bp, Artificial Sequence
  TRBV6-7_RN2v
agaagttcccaatggctacaatgtctccagatcraaaca

SEQ ID NO: 5595 - DNA, 37 bp, Artificial Sequence
  TRBV6-4_RN2v3
aagtccctgatggttatagtgtctccagagcraaaca

SEQ ID NO: 5596 - DNA, 35 bp, Artificial Sequence
  TRBV6-1_RN2v3
gtccccaatggctacaatgtctccagattraaaca

SEQ ID NO: 5597 - DNA, 33 bp, Artificial Sequence
  TRBV7-9_RN2v3
ttctctgcagagaggcctaagggatctrctctc

SEQ ID NO: 5598 - DNA, 30 bp, Artificial Sequence
  TRBV7-3_RN2v3
gcccaacgatcggttctttgcagtrcaggc

SEQ ID NO: 5599 - DNA, 29 bp, Artificial Sequence
  TRBV7-4_RN2v3
ccagtggtcggttctctgcagagraggcc

SEQ ID NO: 5600 - DNA, 34 bp, Artificial Sequence
  TRBV5-6_RN2v3
gcaacttccctgatcgattctcaggtcarccagt

SEQ ID NO: 5601 - DNA, 39 bp, Artificial Sequence
  TRBV5-8_RN2v3
cagaggaaacttccctcctagattttcaggtcgrccagt

SEQ ID NO: 5602 - DNA, 32 bp, Artificial Sequence
  TRBV7-8_RN2v3
gcccagtgatcgcttctttgcagaaarggcct

SEQ ID NO: 5603 - DNA, 32 bp, Artificial Sequence
  TRBV12-2_RN2v3
cgattctcagctgagaggcctgatggratcat

SEQ ID NO: 5604 - DNA, 36 bp, Artificial Sequence
  TRBV15_RN2v3
aggccgaacacttctttctgctttcttgacratccg

SEQ ID NO: 5605 - DNA, 33 bp, Artificial Sequence
  TRBV6-2_RN2v3
  misc_feature (29)..(29): n = uracil
caaaggagaggtccctgatggctacaarngtct

SEQ ID NO: 5606 - DNA, 34 bp, Artificial Sequence
  TRBV23-1_RN2v3
gattctcatctcaatgccccaagaacgcraccct

SEQ ID NO: 5607 - DNA, 37 bp, Artificial Sequence
  TRBV10-2_RN2v3
  misc_feature (33)..(33): n = uracil
cagataaaggagaagtccccgatggctatgtrngtct

SEQ ID NO: 5608 - DNA, 30 bp, Artificial Sequence
  TRBV30_RN2v3
  misc_feature (26)..(26): n = uracil
caggaccggcagttcatcctgagtrnctaa

SEQ ID NO: 5609 - DNA, 42 bp, Artificial Sequence
  TRBV10-3_RN2v3
  misc_feature (38)..(38): n = uracil
agatactgacaaaggagaagtctcagatggctatagrngtct

SEQ ID NO: 5610 - DNA, 36 bp, Artificial Sequence
  TRBV6-6_RN2v3
gacaaaggagaagtcccgaatggctacaacrgtctc

SEQ ID NO: 5611 - DNA, 37 bp, Artificial Sequence
  TRBV13_RN2v3
ccctgatcgattctcagctcaacagttcagtrgacta

SEQ ID NO: 5612 - DNA, 36 bp, Artificial Sequence
  TRBV4-1_RN2v3
cctgaatgccccaacagctctctcttaaacrcttca

SEQ ID NO: 5613 - DNA, 36 bp, Artificial Sequence
  TRBV4-3_RN2v3
cctgaatgccccaacagctctcacttattcrcttca

SEQ ID NO: 5614 - DNA, 43 bp, Artificial Sequence
  TRBV26_RN2v3
ggagatgtctctgagaggtatcatgtttcttgaaatarctata

SEQ ID NO: 5615 - DNA, 43 bp, Artificial Sequence
  TRBV6-8_RN2v3
  misc_feature (39)..(39): n = uracil
tacaatgtctctagattaaacacagaggatttcccacrncagg

SEQ ID NO: 5616 - DNA, 36 bp, Artificial Sequence
  TRBV3-2_RN2v3
  misc_feature (32)..(32): n = uracil
ttctcacctgactctccagacaaagctcatrntaaa

SEQ ID NO: 5617 - DNA, 36 bp, Artificial Sequence
  TRBV11-2_RN2v3
cctaaggatcgattttctgcagagaggctcraaagg

SEQ ID NO: 5618 - DNA, 35 bp, Artificial Sequence
  TRBV2_RN2v3
cctgaatgccctgacagctctcgcttatarccttc

SEQ ID NO: 5619 - DNA, 43 bp, Artificial Sequence
  TRBV3-1_RN2v3
  misc_feature (39)..(39): n = uracil
gcttctcacctaaatctccagacaaagctcacttaaarncttc

SEQ ID NO: 5620 - DNA, 35 bp, Artificial Sequence
  TRBV29-1_RN2v3
catcagccgcccaaacctaacattctcaarctctg

SEQ ID NO: 5621 - DNA, 35 bp, Artificial Sequence
  TRBV18_RN2v3
attttctgctgaatttcccaaagagggccrccagc

SEQ ID NO: 5622 - DNA, 35 bp, Artificial Sequence
  TRBV17_RN2v3
attcacagctgaaagacctaacggaacgtrcttcc

SEQ ID NO: 5623 - DNA, 32 bp, Artificial Sequence
  TRBV20-1_RN2v3
caagcctgaccttgtccactctgacargtgac

SEQ ID NO: 5624 - DNA, 30 bp, Artificial Sequence
  TRBV7-6_RN2v3
ggttctctgcagagaggcctgaggrgatcc

SEQ ID NO: 5625 - DNA, 40 bp, Artificial Sequence
  TRBV24-1_RN2v3
gagagatctctgatggatacagtgtctctcgacarggcac

SEQ ID NO: 5626 - DNA, 32 bp, Artificial Sequence
  TRBV7-2_RN2v3
gatcgcttctctgcagagaggactggrgggat

SEQ ID NO: 5627 - DNA, 35 bp, Artificial Sequence
  TRBV6-9_RN2v3
  misc_feature (31)..(31): n = uracil
aaggagaagtccccgatggctacaatgtarnccag

SEQ ID NO: 5628 - DNA, 35 bp, Artificial Sequence
  TRBV6-5_RN2v3
  misc_feature (31)..(31): n = uracil
aaggagaagtccccaatggctacaatgtcrnccag

SEQ ID NO: 5629 - DNA, 36 bp, Artificial Sequence
  TRBV5-5_RN2v3
  misc_feature (32)..(32): n = uracil
aagaggaaacttccctgatcgattctcagcrncgcc

SEQ ID NO: 5630 - DNA, 41 bp, Artificial Sequence
  TRBV10-1_RN2v3
  misc_feature (37)..(37): n = uracil
gacactaacaaaggagaagtctcagatggctacagrngtct

SEQ ID NO: 5631 - DNA, 41 bp, Artificial Sequence
  TRBJ1-1_RN2v
ttacctacaactgtgagtctggtgccttgtccaaargaaag

SEQ ID NO: 5632 - DNA, 36 bp, Artificial Sequence
  TRBJ1-2_RN2v3
tacaacggttaacctggtccccgaaccgaarggtgt

SEQ ID NO: 5633 - DNA, 40 bp, Artificial Sequence
  TRBJ1-3_RN2v3
  misc_feature (36)..(36): n = uracil
acctacaacagtgagccaacttccctctccaaaarnatat

SEQ ID NO: 5634 - DNA, 37 bp, Artificial Sequence
  TRBJ1-4_RN2v3
caagacagagagctgggttccactgccaaaaraacag

SEQ ID NO: 5635 - DNA, 39 bp, Artificial Sequence
  TRBJ1-5_RN2v3
acctaggatggagagtcgagtcccatcaccaaaratgct

SEQ ID NO: 5636 - DNA, 34 bp, Artificial Sequence
  TRBJ1-6_RN2v3
tcacagtgagcctggtcccgttcccaaargtgga

SEQ ID NO: 5637 - DNA, 31 bp, Artificial Sequence
  TRBJ2-1_RN2v3
cggtgagccgtgtccctggcccgaargaact

SEQ ID NO: 5638 - DNA, 37 bp, Artificial Sequence
  TRBJ2-2RN2v3
ccagtacggtcagcctagagccttctccaaaraaaca

SEQ ID NO: 5639 - DNA, 32 bp, Artificial Sequence
  TRBJ2-3_RN2v3
actgtcagccgggtgcctgggccaaaratact

SEQ ID NO: 5640 - DNA, 28 bp, Artificial Sequence
  TRBJ2-3_RN2v3
agagccgggtcccggcgccgaargtact

SEQ ID NO: 5641 - DNA, 28 bp, Artificial Sequence
  TRBJ2-5_RN2v3
ggagccgcgtgcctggcccgaargtact

SEQ ID NO: 5642 - DNA, 29 bp, Artificial Sequence
  TRBJ2-6_RN2v3
gtcagcctgctgccggccccgaaragtca

SEQ ID NO: 5643 - DNA, 29 bp, Artificial Sequence
  TRBJ2-7_RN2v3
gtgagcctggtgcccggcccgaargtact

SEQ ID NO: 5644 - DNA, 26 bp, Artificial Sequence
  TCRB V7 family-specific real time PCR probe
gggactcagcygtgtatctctgtgcc

SEQ ID NO: 5645 - DNA, 284 bp, Artificial Sequence
  Synthetic DNA:TRBV1*01
gatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagccaaga

SEQ ID NO: 5646 - DNA, 289 bp, Artificial Sequence
  Synthetic DNA: TRBV2*01
gaacctgaagtcacccagactcccagccatcaggtcacacagatgggacaggaagtgatcttgcgctgtgtccccatctctaatcacttatacttctattggtacagacaaatcttgggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgaagc

SEQ ID NO: 5647 - DNA, 288 bp, Artificial Sequence
  Synthetic DNA: TRBV2*03
gaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgagaggcctgatggatcaaatttcactctgaagatccggtccacaaagctggaggactcagccatgtacttctgtgccagcagtgaa

SEQ ID NO: 5648 - DNA, 287 bp, Artificial Sequence
  Synthetic DNA: TRBV3-1*01
gacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccaaga

SEQ ID NO: 5649 - DNA, 279 bp, Artificial Sequence
  Synthetic DNA: TRBV3-1*02
gacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataacaaggagatcattataaatgaaacagttccaaatcgattctcacctaaatctccagacaaagctaaattaaatcttcacatcaattccctggagcttggtgactctgctgtgtatttctgtgccagc

SEQ ID NO: 5650 - DNA, 287 bp, Artificial Sequence
  Synthetic DNA: TRBV3-2*01
gacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagccaaga

SEQ ID NO: 5651 - DNA, 287 bp, Artificial Sequence
  Synthetic DNA: TRBV3-2*02
gacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagttcatttaaatcttcacatcaattccctggagcttggtgactctgctgtgtatttctgtgccagcagccaaga

SEQ ID NO: 5652 - DNA, 285 bp, Artificial Sequence
  Synthetic DNA: TRBV3-2*03
gacacagccgtttcccagactccaaaatacctggtcacacagacgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagttcatttaaatcttcacatcaattccctggagcttggtgactctgctgtgtatttctgtgccagcagccaa

SEQ ID NO: 5653 - DNA, 287 bp, Artificial Sequence
  Synthetic DNA: TRBV4-1*01
gacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagccaaga

SEQ ID NO: 5654 - DNA, 258 bp, Artificial Sequence
  Synthetic DNA: TRBV4-1*02
cacctggtcatgggaatgacaaataagaagtctttgaaatgtgaacaacatatggggcacagggcaatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagccaa

SEQ ID NO: 5655 - DNA, 287 bp, Artificial Sequence
  Synthetic DNA: TRBV4-2*01
gaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagccaaga

SEQ ID NO: 5656 - DNA, 282 bp, Artificial Sequence
  Synthetic DNA: TRBV4-2*02
gaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttatgccttcacctacacaccctgcagccagaagactcggccctgtatctctgtgccagcacc

SEQ ID NO: 5657 - DNA, 287 bp, Artificial Sequence
  Synthetic DNA: TRBV4-3*01
gaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagccaaga

SEQ ID NO: 5658 - DNA, 282 bp, Artificial Sequence
  Synthetic DNA: TRBV4-3*02
gaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttatcccttcacctacacaccctgcagccagaagactcggccctgtatctctgcgccagcagc

SEQ ID NO: 5659 - DNA, 282 bp, Artificial Sequence
  Synthetic DNA: TRBV4-3*3
gaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgtgttgaaaacaacagtgtgccaagtcgcttctcacctgaatgccccaacagctctcacttattccttcacctacacaccctgcagccagaagactcggccctgtatctctgcgccagcagc

SEQ ID NO: 5660 - DNA, 231 bp, Artificial Sequence
  Synthetic DNA: TRBV4-3*04
aagaagtctttgaaatgtgaacaacatctggggcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagc

SEQ ID NO: 5661 - DNA, 286 bp, Artificial Sequence
  Synthetic DNA: TRBV5-1*01
aaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcagcttgg

SEQ ID NO: 5662 - DNA, 285 bp, Artificial Sequence
  Synthetic DNA: TRBV5-1*02
agggctggggtcactcaaactccaagacatctgatcaaaacgagaggacagcaagtgacactgggctgctcccctatctctgggcataggagtgtatcctggtaccaacagaccctaggacagggccttcagttcctctttgaatacttcagtgagacacagagaaacaaaggaaacttccttggtcgattctcagggcgccagttctctaactctcgctctgagatgaatgtgagcaccttggagctgggggactcggccctttatctttgcgccagcgcttgc

SEQ ID NO: 5663 - DNA, 286 bp, Artificial Sequence
  Synthetic DNA: TRBV5-3*01
gaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaagcttgg

SEQ ID NO: 5664 - DNA, 286 bp, Artificial Sequence
  Synthetic DNA: TRBV5-3*02
gaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactattgctctgagatgaatgtgagtgccttggagctgggggactcggccctgtatctctgtgccagaagcttgg

SEQ ID NO: 5665 - DNA, 286 bp, Artificial Sequence
  Synthetic DNA: TRBV5-4*01
gagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcagcttgg

SEQ ID NO: 5666 - DNA, 282 bp, Artificial Sequence
  Synthetic DNA: TRBV5-4*02
gagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattataactctgagctgaatgtgaacgccttggagctggacgactcggccctgtatctctgtgccagcagc

SEQ ID NO: 5667 - DNA, 234 bp, Artificial Sequence
  TRBV5-4*03
cagcaagtgacactgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcagc

SEQ ID NO: 5668 - DNA, 192 bp, Artificial Sequence
  Synthetic DNA: TRBV5-4*04
actgtgtcctggtaccaacaggccctgggtcaggggccccagtttatctttcagtattatagggaggaagagaatggcagaggaaactcccctcctagattctcaggtctccagttccctaattatagctctgagctgaatgtgaacgccttggagctggacgactcggccctgtatctctgtgccagcagc

SEQ ID NO: 5669 - DNA, 286 bp, Artificial Sequence
  TRBV5-5*01
gacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcagcttgg

SEQ ID NO: 5670 - DNA, 282 bp, Artificial Sequence
  Synthetic DNA: TRBV5-5*02
gacgctggagtcacccaaagtcccacacacctgatcaaaacgagaggacagcacgtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcagc

SEQ ID NO: 5671 - DNA, 282 bp, Artificial Sequence
  Synthetic DNA: TRBV5-5*03
gacgctggagtcacccaaagtcccacacacctgatcaaaacgagaggacagcaagtgactctgagatgctctcctatctctgagcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcagc

SEQ ID NO: 5672 - DNA, 286 bp, Artificial Sequence
  Synthetic DNA: TRBV5-6*01
gacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcagcttgg

SEQ ID NO: 5673 - DNA, 286 bp, Artificial Sequence
  Synthetic DNA: TRBV5-7*01
gacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcagcttgg

SEQ ID NO: 5674 - DNA, 286 bp, Artificial Sequence
  Synthetic DNA: TRBV5-8*01
gaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcagcttgg

SEQ ID NO: 5675 - DNA, 238 bp, Artificial Sequence
  Synthetic DNA: TRBV5-8*02
aggacagcaagcgactctgagatgctctcctatctctgggcacaccagtgtgtactggtaccaacaggccctgggtctgggcctccagctcctcctttggtatgacgagggtgaagagagaaacagaggaaacttccctcctagattttcaggtcgccagttccctaattatagctctgagctgaatgtgaacgccttggagctggaggactcggccctgtatctctgtgccagcagc

SEQ ID NO: 5676 - DNA, 287 bp, Artificial Sequence
  Synthetic DNA: TRBV6-1*01
aatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaagc

SEQ ID NO: 5677 - DNA, 287 bp, Artificial Sequence
  Synthetic DNA: TRBV6-2*01
aatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttactc

SEQ ID NO: 5678 - DNA, 287 bp, Artificial Sequence; identical to SEQ ID NO: 5677
  TRBV6-3*01

SEQ ID NO: 5679 - DNA, 287 bp, Artificial Sequence
  Synthetic DNA: TRBV6-4*01
attgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgactc

SEQ ID NO: 5680 - DNA, 287 bp, Artificial Sequence
  Synthetic DNA: TRBV6-4*02
actgctgggatcacccaggcaccaacatctcagatcctggcagcaggacggagcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgactc

SEQ ID NO: 5681 - DNA, 287 bp, Artificial Sequence
  Synthetic DNA: TRBV6-5*01
aatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagttactc

SEQ ID NO: 5682 - DNA, 287 bp, Artificial Sequence
  Synthetic DNA: TRBV6-6*01
aatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagttactc

SEQ ID NO: 5683 - DNA, 282 bp, Artificial Sequence
  Synthetic DNA: TRBV6-6*02
aatgctggtgtcactcagaccccaaaattccgcatcctgaagataggacagagcatgacactgcagtgtgcccaggatatgaaccataactacatgtactggtatcgacaagacccaggcatggggctgaagctgatttattattcagttggtgctggtatcactgacaaaggagaagtcccgaatggctacaacgtctccagatcaaccacagaggatttcccgctcaggctggagttggctgctccctcccagacatctgtgtacttctgtgccagcagt

SEQ ID NO: 5684 - DNA, 282 bp, Artificial Sequence
  Synthetic DNA: TRBV6-6*03
aatgctggtgtcactcagaccccaaaattccgcatcctgaagataggacagagcatgacactgcagtgtgcccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagt

SEQ ID NO: 5685 - DNA, 285 bp, Artificial Sequence
  Synthetic DNA: TRBV6-6*04
aatgctggtgtcactcagaccccaaaattccgcatcctgaagataggacagagcatgacactgcagtgtacccaggatatgaaccatgaatacatgtactggtatcgacaagacccaggcatggggctgaagctgatttattattcagttggtgctggtatcactgataaaggagaagtcccgaatggctacaatgtctccagatcaaccacagaggatttcccgctcaggctggagttggctgctccctcccagacatctgtgtacttctgtgccagcagtcga

SEQ ID NO: 5686 - DNA, 282 bp, Artificial Sequence
  Synthetic DNA: TRBV6-6*05
aatgctggtgtcactcagaccccaaaattccgcatcctgaagataggacagagcatgacactgcagtgtgcccaggatatgaaccataactacatgtactggtatcgacaagacccaggcatggggctgaagctgatttattattcagttggtgctggtatcactgacaaaggagaagtcccgaatggctacaacgtctccagatcaaccacagaggatttcccgctcaggctggagttggctgctgcctcccagacatctgtgtacttctgtgccagcagc

SEQ ID NO: 5687 - DNA, 287 bp, Artificial Sequence
  Synthetic DNA: TRBV6-7*01
aatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagttactc

SEQ ID NO: 5688 - DNA, 284 bp, Artificial Sequence
  Synthetic DNA: TRBV6-8*01
aatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagttactc

SEQ ID NO: 5689 - DNA, 287 bp, Artificial Sequence
  Synthetic DNA: TRBV6-9*01
aatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagttattc

SEQ ID NO: 5690 - DNA, 290 bp, Artificial Sequence
  Synthetic DNA: TRBV7-01*01
ggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagctcagc

SEQ ID NO: 5691 - DNA, 290 bp, Artificial Sequence
  Synthetic DNA: TRBV7-2*01
ggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagcttagc

SEQ ID NO: 5692 - DNA, 290 bp, Artificial Sequence
  Synthetic DNA: TRBV7-2*02
ggagctggagtctcccagtcccccagtaacaaggtcacagagaagggaaaggatgtagagctcaggtgtgatccaatttcaggtcatactgccctttactggtaccgacagaggctggggcagggcctggagtttttaatttacttccaaggcaacagtgcaccagacaaatcagggctgcccagtgatcgcttctctgcagagaggactggggaatccgtctccactctgacgatccagcgcacacagcaggaggactcggccgtgtatctctgtgccagcagcttagc

SEQ ID NO: 5693 - DNA, 290 bp, Artificial Sequence
  Synthetic DNA: TRBV7-2*03
ggagctggagtctcccagtcccccagtaacaaggtcacagagaagggaaaggatgtagagctcaggtgtgatccaatttcaggtcatactgccctttactggtaccgacagaggctggggcagggcctggagtttttaatttacttccaaggcaacagtgcaccagacaaatcagggctgcccagtgatcgcttctctgcagagaggactggggaatccgtctccactctgacgatccagcgcacacagcaggaggactcggccgtgtatctctgtaccagcagcttagc

SEQ ID NO: 5694 - DNA, 288 bp, Artificial Sequence
  Synthetic DNA: TRBV7-2*04
ggagctggagtttcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagctta

SEQ ID NO: 5695 - DNA, 290 bp, Artificial Sequence
  Synthetic DNA: TRBV7-3*01
ggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagcttaac

SEQ ID NO: 5696 - DNA, 290 bp, Artificial Sequence
  Synthetic DNA: TRBV7-3*02
ggtgctggagtctcccagacccccagtaacaaggtcacagagaagggaaaagatgtagagctcaggtgtgatccaatttcaggtcatactgccctttactggtaccgacaaagcctggggcagggcccagagtttctaatttacttccaaggcacgggtgcggcagatgactcagggctgcccaaagatcggttctttgcagtcaggcctgagggatccgtctctactctgaagatccagcgcacagagcagggggactcagccgtgtatctccgtgccagcagcttaac

SEQ ID NO: 5697 - DNA, 288 bp, Artificial Sequence
  Synthetic DNA: TRBV7-3*03
ggtgctggagtctcccagacccccagtaacaaggtcacagagaagggaaaagatgtagagctcaggtgtgatccaatttcaggtcatactgccctttactggtaccgacaaagcctggggcagggcccagagtttctaatttacttccaaggcacgggtgcggcagatgactcagggctgcccaaagatcggttctttgcagtcaggcctgagggatccgtctctactctgaagatccagcgcacagagcagggggactcagccgcgtatctccgtgccagcagctta

SEQ ID NO: 5698 - DNA, 285 bp, Artificial Sequence
  Synthetic DNA: TRBV7-3*04
ggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactctgccgtgtatctctgtgccagcagc

SEQ ID NO: 5699 - DNA, 231 bp, Artificial Sequence
  Synthetic DNA: TRBV7-3*05
tgggagctcaggtgtgatccaatttcaggtcatactgccctttactggtaccgacaaagcctggggcagggcccagagcttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagc

SEQ ID NO: 5700 - DNA, 290 bp, Artificial Sequence
  Synthetic DNA: TRBV7-4*01
ggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagcttagc

SEQ ID NO: 5701 - DNA, 288 bp, Artificial Sequence
  Synthetic DNA: TRBV7-5*01
ggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagcttag

SEQ ID NO: 5702 - DNA, 289 bp, Artificial Sequence
  Synthetic DNA: TRBV7-5*02
ggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgtcagaagcttagc

SEQ ID NO: 5703 - DNA, 290 bp, Artificial Sequence
  Synthetic DNA: TRBV7-6*01
ggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagcttagc

SEQ ID NO: 5704 - DNA, 285 bp, Artificial Sequence
  Synthetic DNA: TRBV7-6*02
ggtgctggagtctcccagtctcccaggtacaaagtcacaaagaggggacaggatgtagctctcaggtgtgatccaatctcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagc

SEQ ID NO: 5705 - DNA, 290 bp, Artificial Sequence
  Synthetic DNA: TRBV7-7*01
ggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagcttagc

SEQ ID NO: 5706 - DNA, 285 bp, Artificial Sequence
  Synthetic DNA: TRBV7-7*02
ggtgctggagtctcccagtctcccaggtacaaagtcacaaagaggggacaggatgtaactctcaggtgtgatccaatttcgagtcatgtaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagc

SEQ ID NO: 5707 - DNA, 290 bp, Artificial Sequence
  Synthetic DNA: TRBV7-8*01
ggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcttagc

SEQ ID NO: 5708 - DNA, 290 bp, Artificial Sequence
  Synthetic DNA: TRBV7-8*02
ggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagaaggaggactccgccgtgtatctctgtgccagcagcttagc

SEQ ID NO: 5709 - DNA, 288 bp, Artificial Sequence
  Synthetic DNA: TRBV7-8*03
ggtgctggagtctcccagtcccctaggtacaaagtcgcaaagagaggacaggatgtagctctcaggtgtgatccaatttcgggtcatgtatcccttttttggtaccaacaggccctcgggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagccga

SEQ ID NO: 5710 - DNA, 288 bp, Artificial Sequence
  Synthetic DNA: TRBV7-9*05
gatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctctctccaccttggagatccagcgcacagagcagggggactcggccatgtatctctgtgccagcaccaaa

SEQ ID NO: 5711 - DNA, 288 bp, Artificial Sequence
  Synthetic DNA: TRBV7-9*06
gatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctctttccaccttggagatccagcgcacagagcagggggactcggccatgtatctctgtgccagcacgttg

SEQ ID NO: 5712 - DNA, 285 bp, Artificial Sequence
  Synthetic DNA: TRBV7-9*03
gatactggagtctcccaggaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagc

SEQ ID NO: 5713 - DNA, 290 bp, Artificial Sequence
  Synthetic DNA: TRBV7-9*01
gatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcttagc

SEQ ID NO: 5714 - DNA, 288 bp, Artificial Sequence
  Synthetic DNA: TRBV7-9*02
gatactggagtctcccagaaccccagacacaacatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagctta

SEQ ID NO: 5715 - DNA, 207 bp, Artificial Sequence
  Synthetic DNA: TRBV7-9*07
cacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagaggagggggactcggccatgtatctctgtgccagcagcagcagt

SEQ ID NO: 5716 - DNA, 288 bp, Artificial Sequence
  Synthetic DNA: TRBV7-9*04
atatctggagtctcccacaaccccagacacaagatcacaaagaggggacagaatgtaactttcaggtgtgatccaatttctgaacacaaccgcctttattggtaccgacagaaccctgggcagggcccagagtttctgacttacttccagaatgaagctcaactggaaaaatcagggctgctcagtgatcggatctctgcagagaggcctaagggatctttctccaccttggagatccagcgcacagagcagggggactcggccatgtatctctgtgccagcagctct

SEQ ID NO: 5717 - DNA, 279 bp, Artificial Sequence
  Synthetic DNA: TRBV8-1*01
gaggcagggatcagccagataccaagatatcacagacacacagggaaaaagatcatcctgaaatatgctcagattaggaaccattattcagtgttctgttatcaataagaccaagaataggggctgaggctgatccattattcaggtagtattggcagcatgaccaaaggcggtgccaaggaagggtacaatgtctctggaaacaagctcaagcattttccctcaaccctggagtctactagcaccagccagacctctgtacctctgtggcagtgcatc

SEQ ID NO: 5718 - DNA, 271 bp, Artificial Sequence
  Synthetic DNA: TRBV8-2*01
gatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagcacatc

SEQ ID NO: 5719 - DNA, 286 bp, Artificial Sequence
  Synthetic DNA: TRBV9*01
gattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgtag

SEQ ID NO: 5720 - DNA, 282 bp, Artificial Sequence
  Synthetic DNA: TRBV9*03
gattctggagtcacacaaaccccaaagcacctgatcacagcaactggacagcgagtgacgctgagatgctcccctaggtctggagacctctctgtgtactggtaccaacagagcctggaccagggcctccagttcctcattcaatattataatggagaagagagagcaaaaggaaacattcttgaacgattctccgcacaacagttccctgacttgcactctgaactaaacctgagctctctggagctgggggactcagctttgtatttctgtgccagcagc

SEQ ID NO: 5721 - DNA, 286 bp, Artificial Sequence
  Synthetic DNA: TRBV9*02
gattctggagtcacacaaaccccaaagcacctgatcacagcaactggacagcgagtgacgctgagatgctcccctaggtctggagacctctctgtgtactggtaccaacagagcctggaccagggcctccagttcctcattcactattataatggagaagagagagcaaaaggaaacattcttgaacgattctccgcacaacagttccctgacttgcactctgaactaaacctgagctctctggagctgggggactcagctttgtatttctgtgccagcagcgtag

SEQ ID NO: 5722 - DNA, 287 bp, Artificial Sequence
  Synthetic DNA: TRBV10-1*01
gatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgagtc

SEQ ID NO: 5723 - DNA, 282 bp, Artificial Sequence
  Synthetic DNA: TRBV10-1*02
gatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcacgacactaacaaaggagaagtctcagatggctacagtgtctctagatcaaacacagaggacctccccctcactctggagtctgctgcctcctcccagacatctgtatatttctgcgccagcagt

SEQ ID NO: 5724 - DNA, 287 bp, Artificial Sequence
  Synthetic DNA: TRBV10-2*01
gatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgagtc

SEQ ID NO: 5725 - DNA, 217 bp, Artificial Sequence
  Synthetic DNA: TRBV10-2*02
aaggcaggtgaccttgatgtgtcaccagacttggagccacagctatatgttctggtatcgacaagacctgggacatgggctgaggctgatctattactcagcagctgctgatattacagataaaggagaagtccccgatggctacgttgtctccagatccaagacagagaatttccccctcactctggagtcagctacccgctcccagacatctgtg

SEQ ID NO: 5726 - DNA, 273 bp, Artificial Sequence
  Synthetic DNA: TRBV10-3*03
gatgctggaatcacccagagcccaagacacaaggtcacagagacaggaacaccagtgactctgagatgtcaccagactgagaaccaccgctacatgtactggtatcgacaagacccggggcatgggctgaggctaatccattactcatatggtgttaaagatactgacaaaggagaagtctcagatggctatagtgtctctagatcaaagacagaggatttcctcctcactctggagtccgctaccagctcccagacatctgtgtacttctgt

SEQ ID NO: 5727 - DNA, 273 bp, Artificial Sequence
  Synthetic DNA: TRBV10-3*04
gatgctggaatcacccagagcccaagacacaaggtcacagagacaggaacaccagtgactctgagatgtcaccagactgagaaccaccgctacatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgt

SEQ ID NO: 5728 - DNA, 287 bp, Artificial Sequence
  Synthetic DNA: TRBV10-3*01
gatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgagtc

SEQ ID NO: 5729 - DNA, 287 bp, Artificial Sequence
  Synthetic DNA: TRBV10-3*02
gatgctggaatcacccagagcccaagacacaaggtcacagagacaggaacaccagtgactctgagatgtcatcagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgagtc

SEQ ID NO: 5730 - DNA, 290 bp, Artificial Sequence
  Synthetic DNA: TRBV11-1*01
gaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagcttagc

SEQ ID NO: 5731 - DNA, 290 bp, Artificial Sequence
  Synthetic DNA: TRBV11-3*01
gaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagcttaga

SEQ ID NO: 5732 - DNA, 285 bp, Artificial Sequence
  Synthetic DNA: TRBV11-3*02
gaagctggagtggttcagtctcccagatataagattatagagaaaaagcagcctgtggctttttggtgcaatcctatttctggccacaataccctttactggtaccggcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagc

SEQ ID NO: 5733 - DNA, 269 bp, Artificial Sequence
  Synthetic DNA: TRBV11-3*03
ggtctcccagatataagattatagagaagaaacagcctgtggctttttggtgcaatccaatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagccagcagagcttggggactcggccatgtatctctgtgccagcagc

SEQ ID NO: 5734 - DNA, 290 bp, Artificial Sequence
  Synthetic DNA: TRBV11-2*01
gaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcttaga

SEQ ID NO: 5735 - DNA, 285 bp, Artificial Sequence
  Synthetic DNA: TRBV11-2*03
gaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccaacctgcaaagcttgaggactcggccgtgtatctctgtgccagcagc

SEQ ID NO: 5736 - DNA, 285 bp, Artificial Sequence
  Synthetic DNA: TRBV11-2*02
gaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgagaactcggccgtgtatctctgtgccagcagt

SEQ ID NO: 5737 - DNA, 290 bp, Artificial Sequence
  Synthetic DNA: TRBV12-1*01
gatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagctttgc

SEQ ID NO: 5738 - DNA, 290 bp, Artificial Sequence
  Synthetic DNA: TRBV12-2*01
gatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgcttagc

SEQ ID NO: 5739 - DNA, 290 bp, Artificial Sequence
  Synthetic DNA: TRBV12-4*01
gatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagc

SEQ ID NO: 5740 - DNA, 288 bp, Artificial Sequence
  Synthetic DNA: TRBV12-4*02
gatgctggagttatccagtcaccccggcacgaggtgacagagatgggacaagaagtgactctgagatgtaaaccaatttcaggacatgactaccttttctggtacagacagaccatgatgcggggactggagttgctcatttactttaacaacaacgttccgatagatgattcagggatgcccgaggatcgattctcagctaagatgcctaatgcatcattctccactctgaggatccagccctcagaacccagggactcagctgtgtacttctgtgccagcagttta

SEQ ID NO: 5741 - DNA, 290 bp, Artificial Sequence
  Synthetic DNA: TRBV12-3*01
gatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagc

SEQ ID NO: 5742 - DNA, 290 bp, Artificial Sequence
  Synthetic DNA: TRBV12-5*01
gatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtttggt

SEQ ID NO: 5743 - DNA, 287 bp, Artificial Sequence
  Synthetic DNA: TRBV12*01
gctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagcttagg

SEQ ID NO: 5744 - DNA, 282 bp, Artificial Sequence
  Synthetic DNA: TRBV13*02
gctgctggagtcatccagtccccaagacatctgatcagagaaaagagggaaacagccactctgaaatgctatcctatccctagacacgacactgtctactggtaccagcagggcccaggtcaggacccccagttcttcatttcgttttatgaaaagatgcagagcgataaaggaagcatccctgatcgattctcagctcaacagttcagtgactatcattctgaactgaacatgagctccttggagctgggggactcagccctgtacttctgtgccagcagc

SEQ ID NO: 5745 - DNA, 290 bp, Artificial Sequence
  Synthetic DNA: TRBV14*01
gaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagccaaga

SEQ ID NO: 5746 - DNA, 285 bp, Artificial Sequence
  Synthetic DNA: TRBV14*02
gaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgaatccggtatgcccaacaatcgattcttagctgaaaggactggagggacgtattctactctgaaggtgcagcctgcagaactggaggattctggagtttatttctgtgccagcagc

SEQ ID NO: 5747 - DNA, 287 bp, Artificial Sequence
  Synthetic DNA: TRBV15*01
gatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagcagaga

SEQ ID NO: 5748 - DNA, 282 bp, Artificial Sequence
  Synthetic DNA: TRBV15*03
gatgccatggtcatccagaacccaagataccgggttacccagtttggaaagccagtgaccctgagttgttctcagactttgaaccataacgtcatgtactggtaccagcagaagtcaagtcaggccccaaagctgctgttccactactataacaaagattttaacaatgaagcagacacccctgataacttccaatccaggaggccgaacacttctttctgctttctagacatccgctcaccaggcctgggggacgcagccatgtaccagtgtgccaccagc

SEQ ID NO: 5749 - DNA, 282 bp, Artificial Sequence
  Synthetic DNA: TRBV15*02
gatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacgcagccatgtacctgtgtgccaccagc

SEQ ID NO: 5750 - DNA, 290 bp, Artificial Sequence
  Synthetic DNA: TRBV16*01
ggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagccaatc

SEQ ID NO: 5751 - DNA, 290 bp, Artificial Sequence
  Synthetic DNA: TRBV16*02
ggtgaagaagtcgcccagactccaaaacatcttgtcagaggggaaggacagaaagcaaaattatattgtgccccaataaaaggacacagttaggttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagccaatc

SEQ ID NO: 5752 - DNA, 285 bp, Artificial Sequence
  Synthetic DNA: TRBV16*03
ggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttggtttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagc

SEQ ID NO: 5753 - DNA, 287 bp, Artificial Sequence
  Synthetic DNA: TRBV17*01
gagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcggtgg

SEQ ID NO: 5754 - DNA, 290 bp, Artificial Sequence
  Synthetic DNA: TRBV18*01
aatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacc

SEQ ID NO: 5755 - DNA, 287 bp, Artificial Sequence
  Synthetic DNA: TRBV19*01
gatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtataga

SEQ ID NO: 5756 - DNA, 287 bp, Artificial Sequence
  Synthetic DNA: TRBV19*02
gatggtggaatcactcagtccccaaagtacctgttcagaaaggaaggacagaatgtgaccctgagttgtgaacagaatttgaaccacgatgccatgtactggtaccgacaggtcccagggcaagggctgagattgatctactactcacacatagtaaatgactttcagaaaggagatatagctgaagggtacagcgtctctcgggagaagaaggaatcctttcctctcactgtgacatcggcccaaaagaacccgacagctttctatctctgtgccagtagtataga

SEQ ID NO: 5757 - DNA, 282 bp, Artificial Sequence
  Synthetic DNA: TRBV19*03
gatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacacatagtaaatgactttcagaaaggagatatagctgaagggtacagcgtctctcgggagaagaaggaatcctttcctctcactgtgacatcggcccaaaagaacccgacagctttctatctctgtgccagtagc

SEQ ID NO: 5758 - DNA, 291 bp, Artificial Sequence
  Synthetic DNA: TRBV20-1*05
ggtgctgtcgtctctcaacatccgagcagggttatctgtaagagtggaacctctgtgaagatcgagtgccgttccctggactttcaggccacaactatgttttggtatcgtcagttcccgaaaaagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctaga

SEQ ID NO: 5759 - DNA, 291 bp, Artificial Sequence
  Synthetic DNA: TRBV20-1*07
ggtgctgtcgtctctcaacatccgagcagggttatctgtaagagtggaacctctgtgaagatcgagtgccgttccctggactttcaggccacaactatgttttggtatcgtcagttcccgaaaaagagtctcatgcagatcgcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctaga

SEQ ID NO: 5760 - DNA, 291 bp, Artificial Sequence
  Synthetic DNA: TRBV20-1*04
ggtgctgtcgtctctcaacatccgagcagggttatctgtaagagtggaacctctgtgaagatcgagtgccgttccttggactttcaggccacaactatgttttggtatcgtcagttcccgaaaaagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagt

SEQ ID NO: 5761 - DNA, 288 bp, Artificial Sequence
  Synthetic DNA: TRBV20-1*06
ggtgctgtcgtctctcaacatccgagtagggttatctgtaagagtggaacctctgtgaagatcgagtgccgttccctggactttcaggccacaactatgttttggtatcgtcagttcccgaaaaagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgct

SEQ ID NO: 5762 - DNA, 288 bp, Artificial Sequence
  Synthetic DNA: TRBV20-1*02
ggtgctgtcgtctctcaacatccgagcagggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgct

SEQ ID NO: 5763 - DNA, 293 bp, Artificial Sequence
  Synthetic DNA: TRBV20-1*01
ggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagaga

SEQ ID NO: 5764 - DNA, 288 bp, Artificial Sequence
  Synthetic DNA: TRBV20-1*03
ggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctgcaaggccacatacgagcaaggcgtcgagaaggacaagtttctcatcaaccatgcaagcctgaccttgtccactctgacagtgaccagtgcccatcctgaagacagcagcttctacatctgcagtgct

SEQ ID NO: 5765 - DNA, 290 bp, Artificial Sequence
  Synthetic DNA: TRBV21-1*01
gacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagc

SEQ ID NO: 5766 - DNA, 288 bp, Artificial Sequence
  Synthetic DNA: TRBV22-1*01
gatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcac

SEQ ID NO: 5767 - DNA, 290 bp, Artificial Sequence
  Synthetic DNA: TRBV23-1*01
catgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatc

SEQ ID NO: 5768 - DNA, 288 bp, Artificial Sequence
  Synthetic DNA: TRBV24-1*01
gatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttg

SEQ ID NO: 5769 - DNA, 287 bp, Artificial Sequence
  Synthetic DNA: TRBV25-1*01
gaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaata

SEQ ID NO: 5770 - DNA, 287 bp, Artificial Sequence
  Synthetic DNA: TRBV26*01
gatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatc

SEQ ID NO: 5771 - DNA, 287 bp, Artificial Sequence
  Synthetic DNA: TRBV27*01
gaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatc

SEQ ID NO: 5772 - DNA, 287 bp, Artificial Sequence
  synthetic DNA: TRBV28*01
gatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatg

SEQ ID NO: 5773 - DNA, 290 bp, Artificial Sequence
  Synthetic DNA: TRBV29-1*01
agtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaaga

SEQ ID NO: 5774 - DNA, 288 bp, Artificial Sequence
  synthetic DNA: TRBV29-1*02
agtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaagtctgactgtgagcaacatgagccctgaagacagcagcatatatctctgcagcgttgaa

SEQ ID NO: 5775 - DNA, 231 bp, Artificial Sequence
  Synthetic DNA: TRBV29-1*03
acgatccagtgtcaagtcgatagccaagtcaccatgatattctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgcgggc

SEQ ID NO: 5776 - DNA, 284 bp, Artificial Sequence
  Synthetic DNA: TRBV30*02
tctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctcctcctcagtgactctggcttctatctctgtgcctggagtgt

SEQ ID NO: 5777 - DNA, 282 bp, Artificial Sequence
  Synthetic DNA: TRBV30*05
tctcagactattcatcaatggccagcgaccctggtgcagcctgtgggcagcccgctctccctggagtgcactgtggagggaacatcaaaccccaacctatactggtaccgacaggctgcaggacggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctgggga

SEQ ID NO: 5778 - DNA, 284 bp, Artificial Sequence
  Synthetic DNA: TRBV30*01
tctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctggagtgt

SEQ ID NO: 5779 - DNA, 276 bp, Artificial Sequence
  Synthetic DNA: TRBV30*04
actattcatcaatggccagcgaccctggtgcagcctgtgggcagcccgctctctctggagtgcactgtggagggaacatcaaaccccaacctatactggtaccgacaggctgcaggcaggggcctccagctgctcttctactccattggtattgaccagatcagctctgaggtgccccagaatctctcagcctccagaccccaggaccggcagttcattctgagttctaagaagctcctcctcagtgactctggcttctatctctgtgcctggagt

SEQ ID NO: 5780 - DNA, 448 bp, Artificial Sequence
  Synthetic DNA: TCRBJ1S1
ttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaa

SEQ ID NO: 5781 - DNA, 448 bp, Artificial Sequence
  Synthetic DNA: TCRBJ1S2
gccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagc

SEQ ID NO: 5782 - DNA, 450 bp, Artificial Sequence
  synthetic DNA: TCRBJ1S3
gattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatg

SEQ ID NO: 5783 - DNA, 451 bp, Artificial Sequence
  Synthetic DNA: TCRBJ1S4
cagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggttt

SEQ ID NO: 5784 - DNA, 450 bp, Artificial Sequence
  Synthetic DNA: TCRBJ1S5
gatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgc

SEQ ID NO: 5785 - DNA, 453 bp, Artificial Sequence
  Synthetic DNA: TCRBJ1S6
atggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctcc

SEQ ID NO: 5786 - DNA, 449 bp, Artificial Sequence
  Synthetic DNA: TCRBJ2S1
aatccactgtgttgtcccccagccaagtggattctcctctgcaaattggtggtggcctcatgcaagatccagttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaa

SEQ ID NO: 5787 - DNA, 451 bp, Artificial Sequence
  Synthetic DNA: TCRBJ2S2
ctgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgg

SEQ ID NO: 5788 - DNA, 449 bp, Artificial Sequence
  Synthetic DNA: TCRBJ2S3
gggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggttt

SEQ ID NO: 5789 - DNA, 450 bp, Artificial Sequence
  Synthetic DNA: TCRBJ2S4
gacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggc

SEQ ID NO: 5790 - DNA, 448 bp, Artificial Sequence
  Synthetic DNA: TCRBJ2S5
ccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccgg

SEQ ID NO: 5791 - DNA, 453 bp, Artificial Sequence
  Synthetic DNA: TCRBJ2S6
cagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggct

SEQ ID NO: 5792 - DNA, 447 bp, Artificial Sequence
  Synthetic DNA: TCRBJ2S7
tgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaat

SEQ ID NO: 5793 - DNA, 50 bp, Homo sapiens
gaattattataagaaactctttggcagtggaacaacactggttgtcacag

SEQ ID NO: 5794 - DNA, 50 bp, Homo sapiens
gaattattataagaaactctttggcagtggaacaacacttgttgtcacag

SEQ ID NO: 5795 - DNA, 47 bp, Homo sapiens
ttattataagaaactctttggcagtggaacaacacttgttgtcacag

SEQ ID NO: 5796 - DNA, 60 bp, Homo sapiens
tgggcaagagttgggcaaaaaaatcaaggtatttggtcccggaacaaagcttatcattac

SEQ ID NO: 5797 - DNA, 60 bp, Homo sapiens
ataccactggttggttcaagatatttgctgaagggactaagctcatagtaacttcacctg

SEQ ID NO: 5798 - DNA, 60 bp, Homo sapiens
atagtagtgattggatcaagacgtttgcaaaagggactaggctcatagtaacttcgcctg

SEQ ID NO: 5799 - DNA, 300 bp, Homo sapiens
tcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactctggggtctattactgtgccacctgggacggg

SEQ ID NO: 5800 - DNA, 297 bp, Homo sapiens
tcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcaaaatctaattgaaaatgactctggggtctattactgtgccacctgggac

SEQ ID NO: 5801 - DNA, 300 bp, Homo sapiens
tcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttatggaagcacaaggaagaacttgagaatgatactgcgaaatcttattgaaaatgactctggagtctattactgtgccacctgggatggg

SEQ ID NO: 5802 - DNA, 300 bp, Homo sapiens
tcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctgggatggg

SEQ ID NO: 5803 - DNA, 300 bp, Homo sapiens
tcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctgggatagg

SEQ ID NO: 5804 - DNA, 297 bp, Homo sapiens
tcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctgggacagg

SEQ ID NO: 5805 - DNA, 300 bp, Homo sapiens
tcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctgggacagg

SEQ ID NO: 5806 - DNA, 299 bp, Homo sapiens
tcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccactgcaagggatgtgttggaatcaggactcagtccaggaaagtattatactcatacacccaggaggtggagctggatattgagactgcaaaatctaattgaaaatgattctggggtctattactgtgccacctgggacag

SEQ ID NO: 5807 - DNA, 300 bp, Homo sapiens
tcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgaagtctccaactcaagggatgtgttggaatcaggtctcagtcttggaaagtattatactcatacaccgaggaggtggagctggaatttgagactgcaaaatctaattgaaaatgattctggggtctattactgtgccacctggggcagg

SEQ ID NO: 5808 - DNA, 300 bp, Homo sapiens
tcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggggcagg

SEQ ID NO: 5809 - DNA, 300 bp, Homo sapiens
tcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctgggacagg

SEQ ID NO: 5810 - DNA, 311 bp, Homo sapiens
ttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtggtgggtggc

SEQ ID NO: 5811 - DNA, 308 bp, Homo sapiens
ttatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgggatta

SEQ ID NO: 5812 - DNA, 309 bp, Homo sapiens
cttgggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggattaggcac

SEQ ID NO: 5813 - DNA, 309 bp, Homo sapiens
cttgggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgagataagtaaaaatgctcacacttccacttccactttgaaaataaagttcttagagaaagaagatgaggtggtgtaccactgtgcctgctggattaggcac

SEQ ID NO: 5814 - DNA, 306 bp, Homo sapiens
gcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtgggaggtg

SEQ ID NO: 5815 - DNA, 306 bp, Homo sapiens
gcaggtcacctagagcaacctcaaatttccagtactaaaacgctgtcaaaaacagcccgcctggaatgtgtggtgtctggaataaaaatttctgcaacatctgtatattggtatcgagagagacctggtgaagtcatacagttcctggtgtccatttcatatgacggcactgtcagaaaggaatctggcattccgtcaggcaaatttgaggtggataggatacctgaaacgtctacatccactctcaccattcacaatgtagagaaacaggacatagctacctactactgtgccttgtgggaggtg

SEQ ID NO: 5816 - DNA, 285 bp, Homo sapiens
ctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctgggccctg

SEQ ID NO: 5817 - DNA, 48 bp, Homo sapiens
actactttgactactggggccaaggaaccctggtcaccgtctcctcag

SEQ ID NO: 5818 - DNA, 48 bp, Homo sapiens
gctactttgactactggggccaagggaccctggtcaccgtctcctcag

SEQ ID NO: 5819 - DNA, 48 bp, Homo sapiens
actactttgactactggggccagggaaccctggtcaccgtctcctcag

SEQ ID NO: 5820 - DNA, 50 bp, Homo sapiens
tgatgcttttgatgtctggggccaagggacaatggtcaccgtctcttcag

SEQ ID NO: 5821 - DNA, 50 bp, Homo sapiens
tgatgcttttgatatctggggccaagggacaatggtcaccgtctcttcag

SEQ ID NO: 5822 - DNA, 63 bp, Homo sapiens
attactactactactacggtatggacgtctgggggcaagggaccacggtcaccgtctcctcag

SEQ ID NO: 5823 - DNA, 62 bp, Homo sapiens
attactactactactacggtatggacgtctggggccaagggaccacggtcaccgtctcctca

SEQ ID NO: 5824 - DNA, 63 bp, Homo sapiens
attactactactactacggtatggacgtctggggcaaagggaccacggtcaccgtctcctcag

SEQ ID NO: 5825 - DNA, 62 bp, Homo sapiens
attactactactactactacatggacgtctggggcaaagggaccacggtcaccgtctcctca

SEQ ID NO: 5826 - DNA, 53 bp, Homo sapiens
ctactggtacttcgatctctggggccgtggcaccctggtcactgtctcctcag

SEQ ID NO: 5827 - DNA, 51 bp, Homo sapiens
acaactggttcgactcctggggccaaggaaccctggtcaccgtctcctcag

SEQ ID NO: 5828 - DNA, 51 bp, Homo sapiens
acaactggttcgacccctggggccagggaaccctggtcaccgtctcctcag

SEQ ID NO: 5829 - DNA, 52 bp, Homo sapiens
gctgaatacttccagcactggggccagggcaccctggtcaccgtctcctcag

SEQ ID NO: 5830 - DNA, 61 bp, Homo sapiens
gctacaagtgcttggagcactggggcagggcagcccggacaccgtctccctgggaacgtca

SEQ ID NO: 5831 - DNA, 54 bp, Homo sapiens
aaaggtgctgggggtcccctgaacccgacccgccctgagaccgcagccacatca

SEQ ID NO: 5832 - DNA, 52 bp, Homo sapiens
cttgcggttggacttcccagccgacagtggtggtctggcttctgaggggtca

SEQ ID NO: 5833 - DNA, 296 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaga

SEQ ID NO: 5834 - DNA, 276 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctaagatctgacgacacggcc

SEQ ID NO: 5835 - DNA, 296 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggacggatcaaccctaacagtggtggcacaaactatgcacagaagtttcagggcagggtcaccagtaccagggacacgtccatcagcacagcctacatggagctgagcaggctgagatctgacgacacggtcgtgtattactgtgcgagaga

SEQ ID NO: 5836 - DNA, 296 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaga

SEQ ID NO: 5837 - DNA, 296 bp, Homo sapiens
  misc_feature (113)..(113): n = A, T, C or G
caggtgcagctggtgcagtctggggctgaggtgaagaagcttggggcctcagtgaaggtctcctgcaaggcttctggatacaccttcaccggctactatatgcactgggtgcnacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaga

SEQ ID NO: 5838 - DNA, 294 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggctgggtcaccatgaccagggacacgtccatcagcacagcctacatggagctgagcaggctgagatctgacgacacggccgtgtattactgtgcgaga

SEQ ID NO: 5839 - DNA, 296 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaga

SEQ ID NO: 5840 - DNA, 296 bp, Homo sapiens
caggtccagcttgtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagaga

SEQ ID NO: 5841 - DNA, 296 bp, Homo sapiens
caggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagaga

SEQ ID NO: 5842 - DNA, 296 bp, Homo sapiens
  misc_feature (295)..(295): n = A, T, C or G
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattactagggacaggtctatgagcacagcctacatggagctgagcagcctgagatctgaggacacagccatgtattactgtgcaagana

SEQ ID NO: 5843 - DNA, 296 bp, Homo sapiens
cagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagata

SEQ ID NO: 5844 - DNA, 260 bp, Homo sapiens
agaagactgggtcctcagtgaaggtttcctgcaaggcttccggatacaccttcacctaccgctacctgcactgggtgcgacaggcccccagacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaaga

SEQ ID NO: 5845 - DNA, 296 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaga

SEQ ID NO: 5846 - DNA, 296 bp, Homo sapiens
caggtgcagctggtgcagtctggggctgaggtgaagaagcctggggcctcagtgaaggtttcctgcaaggcatctggatacaccttcaacagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaga

SEQ ID NO: 5847 - DNA, 296 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgctagaga

SEQ ID NO: 5848 - DNA, 296 bp, Homo sapiens
caaatgcagctggtgcagtctgggcctgaggtgaagaagcctgggacctcagtgaaggtctcctgcaaggcttctggattcacctttactagctctgctgtgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaga

SEQ ID NO: 5849 - DNA, 296 bp, Homo sapiens
caaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaga

SEQ ID NO: 5850 - DNA, 296 bp, Homo sapiens
caggtgcagctggggcagtctgaggctgaggtaaagaagcctggggcctcagtgaaggtctcctgcaaggcttccggatacaccttcacttgctgctccttgcactggttgcaacaggcccctggacaagggcttgaaaggatgagatggatcacactttacaatggtaacaccaactatgcaaagaagttccagggcagagtcaccattaccagggacatgtccctgaggacagcctacatagagctgagcagcctgagatctgaggactcggctgtgtattactgggcaagata

SEQ ID NO: 5851 - DNA, 296 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 5852 - DNA, 294 bp, Homo sapiens
caggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgaga

SEQ ID NO: 5853 - DNA, 275 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgatgacacggc

SEQ ID NO: 5854 - DNA, 296 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 5855 - DNA, 294 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccacggacgaatccacgagcacagcctacatggagctgagcagcctgagatctgaggacacggccgtgtattactgtgcgaga

SEQ ID NO: 5856 - DNA, 296 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 5857 - DNA, 233 bp, Homo sapiens
agaagcctgggtcctcggtgaaggtctcctgcaaggcttctggaggcaccttcagcagctatgctatcagctgggtgcgacaggcccctggacaagggcttgagtggatgggaaggatcatccctatctttggtacagcaaactacgcacagaagttccagggcagagtcacgattaccgcggacgaatccacgagcacagcctacatggagctgagcagcctgagatctgag

SEQ ID NO: 5858 - DNA, 296 bp, Homo sapiens
caggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaaggatcatccctatccttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 5859 - DNA, 296 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 5860 - DNA, 296 bp, Homo sapiens
caggtccagctggtgcagtctggggctgaggtgaagaagcctgggtcctcagtgaaggtctcctgcaaggcttctggaggcaccttcagcagctatgctatcagctgggtgcgacaggcccctggacaagggcttgagtggatgggagggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 5861 - DNA, 296 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 5862 - DNA, 296 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 5863 - DNA, 296 bp, Homo sapiens
caggtccagctggtgcagtctggggctgaggtgaagaagcctgggtcctcagtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 5864 - DNA, 296 bp, Homo sapiens
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagg

SEQ ID NO: 5865 - DNA, 296 bp, Homo sapiens
  misc_feature (136)..(253): n = A, T, C or G
caggttcagctgttgcagcctggggtccaggtgaagaagcctgggtcctcagtgaaggtctcctgctaggcttccagatacaccttcaccaaatactttacacggtgggtgtgacaaagccctggacaagggcatnagtggatgggatgaatcaacccttacaacgataacacacactacgcacagacgttctggggcagagtcaccattaccagtgacaggtccatgagcacagcctacatggagctgagcngcctgagatccgaagacatggtcgtgtattactgtgtgagaga

SEQ ID NO: 5866 - DNA, 260 bp, Homo sapiens
ggaagtctggggcctcagtgaaagtctcctgtagtttttctgggtttaccatcaccagctacggtatacattgggtgcaacagtcccctggacaagggcttgagtggatgggatggatcaaccctggcaatggtagcccaagctatgccaagaagtttcagggcagattcaccatgaccagggacatgtccacaaccacagcctacacagacctgagcagcctgacatctgaggacatggctgtgtattactatgcaaga

SEQ ID NO: 5867 - DNA, 294 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaaca

SEQ ID NO: 5868 - DNA, 233 bp, Homo sapiens
agaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatatgcagagaagttccagggcagagtcaccataaccgcggacacgtctacagacacagcctacatggagctgagcagcctgagatctgag

SEQ ID NO: 5869 - DNA, 294 bp, Homo sapiens
caggtgcagctggtgcagtctggggctgaggtgaagaagcctggggcctcagtgaaggtctcctgcaaggcttctggatacatcttcaccgactactatatgcactgggtgcgacaggcccctggacaagagcttgggtggatgggacggatcaaccctaacagtggtggcacaaactatgcacagaagtttcagggcagagtcaccatgaccagggacacgtccatcagcacagcctacacggagctgagcagcctgagatctgaggacacggccacgtattactgtgcgaga

SEQ ID NO: 5870 - DNA, 296 bp, Homo sapiens
caggtgcagctggtgcagtctggggctgaggtgaagaagcctggggcctcagtgaaggtctcctgcaaggcttctggatacatcttcaccgactactatatgcactgggtgcgacaggcccctggacaagagcttgggtggatgggacggatcaaccctaacagtggtggcacaaactatgcacagaagtttcagggcagagtcaccatgaccagggacacgtccatcagcacagcctgcacggagctgagcagcctgagatctgaggacacggccacgtattactgtgcgagaga

SEQ ID NO: 5871 - DNA, 296 bp, Homo sapiens
caggtgcagctggtgcagtctggagctgaggtgaagaagcctagagcctcagtgaaggtctcctgcaaggcttctggttacacctttaccagctactatatgcactgggtgtgacaggcccctgaacaagggcttgagtggatgggatggatcaacacttacaatggtaacacaaactacccacagaagctccagggcagagtcaccatgaccagagacacatccacgagcacagcctacatggagctgagcaggctgagatctgacgacatggccgtgtattactgtgcgagaga

SEQ ID NO: 5872 - DNA, 294 bp, Homo sapiens
caggtccaactggtgtagtctggagctgaggtgaagaagcctggggcctcagtgaaggtctcctgcaaggcttctggatacaccttcaccgactactttatgaactggatgcgccaggcccctggacaaaggcttgagtggatgggatggatcaacgctggcaatggtaacacaaaatattcacagaagctccagggcagagtcaccattaccagggacacatcttcgagcacagcctacatgcagctgagcagcctgagatctgaggacacggccgtgtattactgtgcgaga

SEQ ID NO: 5873 - DNA, 260 bp, Homo sapiens
agaagcctggggcctcagtgaaggtctcctgcaaggcttctggatacaccttcaccgactactttatgaactggatgcgccaggcccctggacaaaggcttgagtggatgggatggatcaacgctggcaatggtaacacaaaatattcacagaagctccagggcagagtcaccattaccagggacacatctgcgagcacagcctacatgcagctgagcagcctgagatctgaggacacggccgtgtattactgtgcgaga

SEQ ID NO: 5874 - DNA, 294 bp, Homo sapiens
caggtccaactggtgtagtctggagctgaggtgaagaagcctggggcctcagtgaaggtctcctgcaaggcttctggatacaccttcaccagctactatatgaactggatgcgccaggcccctggacaaggcttcgagtggatgggatggatcaacgctggcaatggtaacacaaagtattcacagaagctccagggcagagtcaccattaccagggacacatctgcgagcacagcctacatgcagctgagcagcctgagatctgaggacacggccgtgtattactgtgcgaga

SEQ ID NO: 5875 - DNA, 294 bp, Homo sapiens
caggaccagttggtgcagtctggggctgaggtgaagaagcctctgtcctcagtgaaggtctccttcaaggcttctggatacaccttcaccaacaactttatgcactgggtgtgacaggcccctggacaaggacttgagtggatgggatggatcaatgctggcaatggtaacacaacatatgcacagaagttccagggcagagtcaccataaccagggacacgtccatgagcacagcctacacggagctgagcagcctgagatctgaggacacggccgtgtattactgtgcgaga

SEQ ID NO: 5876 - DNA, 260 bp, Homo sapiens
agaagcctggggcctcagtgaaggtctcctgcaaggcttctggatacaccttcaccagctactgtatgcactgggtgcaccaggtccatgcacaagggcttgagtggatgggattggtgtgccctagtgatggcagcacaagctatgcacagaagttccaggccagagtcaccataaccagggacacatccatgagcacagcctacatggagctaagcagtctgagatctgaggacacggccatgtattactgtgtgaga

SEQ ID NO: 5877 - DNA, 294 bp, Homo sapiens
caggtacagctggtgcagtctggggctgaggtgaagaagcctggggcctcagtgaaggtctcctgcaaggcttctggatacaccttcaccaactactgtatgcactgggtgcgccaggtccatgcacaagggcttgagtggatgggattggtgtgccctagtgatggcagcacaagctatgcacaaaagttccaggccagagtcaccataaccagggacacatccatgagcacagcctacatggagctaagcagtctgagatctgaggacacggccatgtattactgtgtgaga

SEQ ID NO: 5878 - DNA, 296 bp, Homo sapiens
caggtacagctgatgcagtctggggctgaggtgaagaagcctggggcctcagtgaggatctcctgcaaggcttctggatacaccttcaccagctactgtatgcactgggtgtgccaggcccatgcacaagggcttgagtggatgggattggtgtgccctagtgatggcagcacaagctatgcacagaagttccagggcagagtcaccataaccagggacacatccatgggcacagcctacatggagctaagcagcctgagatctgaggacacggccatgtattactgtgtgagaga

SEQ ID NO: 5879 - DNA, 301 bp, Homo sapiens
caggtcaccttgaaggagtctggtcctgcactggtgaaacccacacagaccctcatgctgacctgcaccttctctgggttctcactcagcacttctggaatgggtgtgggttagatctgtcagccctcagcaaaggccctggagtggcttgcacacatttattagaatgataataaatactacagcccatctctgaagagtaggctcattatctccaaggacacctccaagaatgaagtggttctaacagtgatcaacatggacattgtggacacagccacacattactgtgcaaggagac

SEQ ID NO: 5880 - DNA, 301 bp, Homo sapiens
caggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatac

SEQ ID NO: 5881 - DNA, 302 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacc

SEQ ID NO: 5882 - DNA, 124 bp, Homo sapiens
actagtggagtgggtgtgggctggatccgtcagcccccaggaaaggccctggagtggcttgcactcatttattgggatgatgataagcgctacagcccatctctgaagagcaggctcaccatca

SEQ ID NO: 5883 - DNA, 210 bp, Homo sapiens
gctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccattaccaaggacacctccaaaaaccaggt

SEQ ID NO: 5884 - DNA, 297 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacaggcacatattactgtgtacgg

SEQ ID NO: 5885 - DNA, 301 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacggcccatctctgaagagcaggctcaccatcaccaaggacacctccaaaaaccaggtggtccttacaatgaccaacatggaccctgtggacacagccacatattactgtgcacacagac

SEQ ID NO: 5886 - DNA, 300 bp, Homo sapiens
cagatcaccttgaaggagtctggtcctacgctggtaaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacggcccatctctgaagagcaggctcaccatcaccaaggacacctccaaaaaccaggtggtccttacaatgaccaacatggaccctgtggacacagccacatattactgtgcacacaga

SEQ ID NO: 5887 - DNA, 294 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacaggcacatattactgtgta

SEQ ID NO: 5888 - DNA, 301 bp, Homo sapiens
caggtcaccttgaaggagtctggtcctgcgctggtgaaacccacacagaccctcacactgacctgcaccttctctgggttctcactcagcactagtggaatgcgtgtgagctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagac

SEQ ID NO: 5889 - DNA, 301 bp, Homo sapiens
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacggcccatctctgaagagcaggctcaccatcaccaaggacacctccaaaaaccaggtggtccttacaatgaccaacatggaccctgtggacacagccacatattactgtgcacacagac

SEQ ID NO: 5890 - DNA, 297 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacgg

SEQ ID NO: 5891 - DNA, 301 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattactgtgcacggatac

SEQ ID NO: 5892 - DNA, 290 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacggccgtgtattactg

SEQ ID NO: 5893 - DNA, 290 bp, Homo sapiens
caggtcaccttgaaggagtctggtcctgcgctggtgaaacccacacagaccctcacactgacctgcaccttctctgggttctcactcagcactagtggaatgcgtgtgagctggatccgtcagcccccagggaaggccctggagtggcttgcacgcattgattgggatgatgataaattctacagcacatctctgaagaccaggctcaccatctccaaggacacctccaaaaaccaggtggtccttacaatgaccaacatggaccctgtggacacggccgtgtattactg

SEQ ID NO: 5894 - DNA, 288 bp, Homo sapiens
caggtcaccttgaaggagtctggtcctgcgctggtgaaacccacacagaccctcacactgacctgcaccttctctgggttctcactcagcactagtggaatgcgtgtgagctggatccgtcagcccccagggaaggccctggagtggcttgcacgcattgattgggatgatgataaattctacagcacatctctgaagaccaggctcaccatctccaaggacacctccaaaaaccaggtggtccttacaatgaccaacatggaccctgtggacacagccacgtattac

SEQ ID NO: 5895 - DNA, 237 bp, Homo sapiens
tgcgctggtgaaacccacacagaccctcacactgacctgcaccttctctgggttctcactcagcactagtggaatgcgtgcgagctggatccgtcagcccccagggaaggccctggagtggcttgcacgcattgattgggatgatgataaattctacagcacatctctgaagaccaggctcaccatctccaaggacacctccaaaaaccaggtggtccttacaatgaccaacatgga

SEQ ID NO: 5896 - DNA, 290 bp, Homo sapiens
caggtcaccttgaaggagtctggtcctgcgctggtgaaacccacacagaccctcacactgacctgcaccttctctgggttctcactcagcactagtggaatgcgtgtgagctggatccgtcagcccccagggaaggccctggagtggcttgcacgcattgattgggatgatgataaattctacagcacatccctgaagaccaggctcaccatctccaaggacacctccaaaaaccaggtggtccttacaatgaccaacatggaccctgtggacacggccgtgtattactg

SEQ ID NO: 5897 - DNA, 290 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccggggaaggccctggagtggcttgcactcattgattgggatgatgataaatactacagcacatctctgaagaccaggctcaccatctccaaggacacctccaaaaaccaggtggtccttacaatgaccaacatggaccctgtggacacggccgtgtattactg

SEQ ID NO: 5898 - DNA, 290 bp, Homo sapiens
caggtcaccttgagggagtctggtcctgcgctggtgaaacccacacagaccctcacactgacctgcgccttctctgggttctcactcagcactagtggaatgtgtgtgagctggatccgtcagcccccagggaaggccctggagtggcttgcacgcattgattgggatgatgataaatactacagcacatctctgaagaccaggctcaccatctccaaggacacctccaaaaaccaggtggtccttacaatgaccaacatggaccctgtggacacggccgtgtattactg

SEQ ID NO: 5899 - DNA, 297 bp, Homo sapiens
cagatcaccttgaaggagtctggtcctacgctggtgaaacccacacagaccctcacgctgacccgcaccttctctgggttctcactcagcactagtggaatgtgtgtgagctggatccgtcagcccccagggaaggccctggagtggcttgcactcattgattgggatgatgataaatactacagcacatctctgaacaccaggctcaccatctccaaggacacctccaaaaaccaggtggtccttacaatgaccaacatggaccctgtggacacaggcacatattactgtgtacgg

SEQ ID NO: 5900 - DNA, 301 bp, Homo sapiens
caggtcaccttgaaggagtctggtcctgcgctggtgaaacccacacagaccctcacactgacctgcaccttctctgggttctcactcagcactagtggaatgcgtgtgagctggatccgtcagcccccagggaaggccctggagtggattgcacgcattgattgggatgatgataaatactacagcacatctctgaagaccaggctcaccatctccaaggacacctccaaaaaccaggtggtccttacaatgaccaacatggaccctgtggacacagccacgtattactgtgcacggatac

SEQ ID NO: 5901 - DNA, 301 bp, Homo sapiens
cagatcaccttgaaggagtctggtcctacgctggtgaaacccacacagaccctcacgctgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacatattactgtgcacacagac

SEQ ID NO: 5902 - DNA, 301 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatac

SEQ ID NO: 5903 - DNA, 301 bp, Homo sapiens; identical to SEQ ID NO: 5902

SEQ ID NO: 5904 - DNA, 298 bp, Homo sapiens
caggtcaccttgaaggagtctggtcctgcgctggtgaaacccacagagaccctcacgctgacctgcactctctctgggttctcactcagcacttctggaatgggtatgagctggatccgtcagcccccagggaaggccctggagtggcttgctcacatttttttgaatgacaaaaaatcctacagcacgtctctgaagaacaggctcatcatctccaaggacacctccaaaagccaggtggtccttaccatgaccaacatggaccctgtggacacagccacgtattactgtgcatgga

SEQ ID NO: 5905 - DNA, 296 bp, Homo sapiens
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagaga

SEQ ID NO: 5906 - DNA, 294 bp, Homo sapiens
caggtgcagctgttggagtctgggggaggcttggtcaagcctggagggtccctgagactctcctgtgcagcctctggattcaccttcagtgactactacatgagctggatccgccaggctccagggaaggggctggagtgggtttcatacattagtagtagtagtagttacacaaactacgcagactctgtgaagggccgattcaccatctccagagacaacgccaagaactcactgtatctgcaaatgaacagcctgagagccgaggacacggccgtgtattactgtgcgaga

SEQ ID NO: 5907 - DNA, 293 bp, Homo sapiens
gaggtgcatctggtggagtctgggggaggcttggtacagcctgggggggccctgagactctcctgtgcagcctctggattcaccttcagtaactacgacatgcactgggtccgccaagctacaggaaaaggtctggagtgggtctcagccaatggtactgctggtgacacatactatccaggctccgtgaaggggcgattcaccatctccagagaaaatgccaagaactccttgtatcttcaaatgaacagcctgagagccggggacacggctgtgtattactgtgcaagaga

SEQ ID NO: 5908 - DNA, 293 bp, Homo sapiens; identical to SEQ ID NO: 5907

SEQ ID NO: 5909 - DNA, 291 bp, Homo sapiens
gaggtgcagctggtggagtctgggggaggcttggtacagcctggggggtccctgagactctcctgtgcagcctgtggattcaccttcagtagctacgacatgcactgggtccgccaagctacaggaaaaggtctggagtgggtctcagctattggtactgctggtgacacatactatccaggctccgtgaagggccaattcaccatctccagagaaaatgccaagaactccttgtatcttcaaatgaacagcctgagagccggggacacggctgtgtattactgtgcaaga

SEQ ID NO: 5910 - DNA, 302 bp, Homo sapiens
gaggtgcagctggtggagtctgggggagccttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaga

SEQ ID NO: 5911 - DNA, 302 bp, Homo sapiens
gaggtgcagctggtggagtctgccggagccttggtacagcctggggggtcccttagactctcctgtgcagcctctggattcacttgcagtaacgcctggatgagctgggtccgccaggctccagggaaggggctggagtgggttggccgtattaaaagcaaagctaatggtgggacaacagactacgctgcacctgtgaaaggcagattcaccatctcaagagttgattcaaaaaacacgctgtatctgcaaatgaacagcctgaaaaccgaggacacagccgtgtattactgtaccacaga

SEQ ID NO: 5912 - DNA, 302 bp, Homo sapiens
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattgaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaga

SEQ ID NO: 5913 - DNA, 302 bp, Homo sapiens
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagtctgaaaaccgaggacacagccgtgtattactgtaccacaga

SEQ ID NO: 5914 - DNA, 302 bp, Homo sapiens
gaggtgcagctggtggagtctgggggaggcttggtaaagcctggggggtcccttagactctcctgtgcagcctctggattcactttcagtaacgcctggatgagctgggtccgccaggctccagggaaggggctggagtgggtcggccgtattaaaagcaaaactgatggtgggacaacaaactacgctgcacccgtgaaaggcagattcaccatctcaagagatgattcaaaaaacacgctgtatctgcaaatgaacagcctgaaaaccgaggacacagccgtgtattactgtaccacaga

SEQ ID NO: 5915 - DNA, 302 bp, Homo sapiens
gaggtgcagctggtggagtctgggggaggcttggtaaagcctggggggtcccttagactctcctgtgcagcctctggtttcactttcagtaacgcctggatgaactgggtccgccaggctccagggaaggggctggagtgggtcggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaga

SEQ ID NO: 5916 - DNA, 302 bp, Homo sapiens; identical to SEQ ID NO: 5915

SEQ ID NO: 5917 - DNA, 302 bp, Homo sapiens
gaggtgcagctggtggagtctgcgggaggcttggtacagcctggggggtcccttagactctcctgtgcagcctctggattcacttgcagtaacgcctggatgagctgggtccgccaggctccagggaaggggctggagtgggttggctgtattaaaagcaaagctaatggtgggacaacagactacgctgcacctgtgaaaggcagattcaccatctcaagagatgattcaaaaaacacgctgtatctgcaaatgatcagcctgaaaaccgaggacacggccgtgtattactgtaccacagg

SEQ ID NO: 5918 - DNA, 296 bp, Homo sapiens
gaggtacaactggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaa

SEQ ID NO: 5919 - DNA, 296 bp, Homo sapiens
gaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaa

SEQ ID NO: 5920 - DNA, 296 bp, Homo sapiens
acagtgcagctggtggagtctgggggaggcttggtagagcctggggggtccctgagactctcctgtgcagcctctggattcaccttcagtaacagtgacatgaactgggtccgccaggctccaggaaaggggctggagtgggtatcgggtgttagttggaatggcagtaggacgcactatgcagactctgtgaagggccgattcatcatctccagagacaattccaggaacttcctgtatcagcaaatgaacagcctgaggcccgaggacatggctgtgtattactgtgtgagaaa

SEQ ID NO: 5921 - DNA, 296 bp, Homo sapiens
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagaga

SEQ ID NO: 5922 - DNA, 296 bp, Homo sapiens
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaga

SEQ ID NO: 5923 - DNA, 296 bp, Homo sapiens
gaggtgcaactggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaga

SEQ ID NO: 5924 - DNA, 302 bp, Homo sapiens
gaggtgcatctggtggagtctgggggagccttggtacagcctggggggtccctgagactctcctgtgcagcctctggattcaccttcagttactactacatgagcggggtccgccaggctcccgggaaggggctggaatgggtaggtttcattagaaacaaagctaatggtgggacaacagaatagaccacgtctgtgaaaggcagattcacaatctcaagagatgattccaaaagcatcacctatctgcaaatgaagagcctgaaaaccgaggacacggccgtgtattactgttccagaga

SEQ ID NO: 5925 - DNA, 302 bp, Homo sapiens
gaggtgcagctggtggagtctgggggaggcttggtacagcctggggggtccctgagactctcctgtgcagcctctggattcaccttcagttactactacatgagcggggtccgccaggctcccgggaaggggctggaatgggtaggtttcattagaaacaaagctaatggtgggacaacagaatagaccacgtctgtgaaaggcagattcacaatctcaagagatgattccaaaagcatcacctatctgcaaatgaagagcctgaaaaccgaggacacggccgtgtattactgttccagaga

SEQ ID NO: 5926 - DNA, 296 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaga

SEQ ID NO: 5927 - DNA, 296 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacggagactccgtgaagggccggttcaccatctcaagagacaattccaagaacacgctgtatctgcaaatgaacagcctgagagccgaggacacggccgtatattactgtgcgaaaga

SEQ ID NO: 5928 - DNA, 294 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttatttatagcggtggtagtagcacatactatgcagactccgtgaagggccggttcaccatctccagagataattccaagaacacgctgtatctgcaaatgaacagcctgagagccgaggacacggccgtatattactgtgcgaaa

SEQ ID NO: 5929 - DNA, 296 bp, Homo sapiens
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaga

SEQ ID NO: 5930 - DNA, 294 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctatttatagcagtggtagtagcacatactatgcagactccgtgaagggccggttcaccatctccagagacaattccaagaacacgctgtatctgcaaatgaacagcctgagagccgaggacacggccgtatattactgtgcgaaa

SEQ ID NO: 5931 - DNA, 296 bp, Homo sapiens
gagatgcagctggtggagtctgggggaggcttgcaaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtaccagaga

SEQ ID NO: 5932 - DNA, 296 bp, Homo sapiens
gagatgcagctggtggagtctgggggaggcttggcaaagcctgcgtggtccccgagactctcctgtgcagcctctcaattcaccttcagtagctactacatgaactgtgtccgccaggctccagggaatgggctggagttggtttgacaagttaatcctaatgggggtagcacatacctcatagactccggtaaggaccgattcaatacctccagagataacgccaagaacacacttcatctgcaaatgaacagcctgaaaaccgaggacacggccctctattagtgtaccagaga

SEQ ID NO: 5933 - DNA, 294 bp, Homo Sapiens
gagatgcagctggtggagtctgggggaggcttggcaaagcctgcgtggtccccgagactctcctgtgcagcctctcaattcaccttcagtagctactacatgaactgtgtccgccaggctccagggaatgggctggagttggttggacaagttaatcctaatgggggtagcacatacctcatagactccggtaaggaccgattcaatacctccagagataacgccaagaacacacttcatctgcaaatgaacagcctgaaaaccgaggacacggccctgtattagtgtaccaga

SEQ ID NO: 5934 - DNA, 296 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 5935 - DNA, 296 bp, Homo sapiens
caggtgcagctggtggagtctgggggaggcgtggtccagcctggggggtccctgagactctcctgtgcagcgtctggattcaccttcagtagctatggcatgcactgggtccgccaggctccaggcaaggggctggagtgggtggcatttatacggtatgatggaagtaataaatactatgcagactccgtgaagggccgattcaccatctccagagacaattccaagaacacgctgtatctgcaaatgaacagcctgagagctgaggacacggctgtgtattactgtgcgaaaga

SEQ ID NO: 5936 - DNA, 296 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaga

SEQ ID NO: 5937 - DNA, 296 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 5938 - DNA, 296 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgagggcacggctgtgtattactgtgcgagaga

SEQ ID NO: 5939 - DNA, 296 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 5940 - DNA, 296 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagccgaggacacggctgtgtattactgtgcgagaga

SEQ ID NO: 5941 - DNA, 294 bp, Homo sapiens
caggtgcagctggtggactctgggggaggcgtggtccagcctgggaggtccctgagactctcctgtgcagcctctgcattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaga

SEQ ID NO: 5942 - DNA, 296 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcgccatctccagagacaattccaagaacacgctgtatctgcaaatgaacagcctgagagctgaggacacggctgtgtattactgtgcgagaga

SEQ ID NO: 5943 - DNA, 296 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctagagtgggtggcagttatatcatatgatggaagtaataaatactacacagactccgtgaagggccgattcaccatctccagagacaattccaagaacacgctgtatctgcaaatgaacagcctgagagctgaggacacggctgtgtattactgtgcgagaga

SEQ ID NO: 5944 - DNA, 296 bp, Homo sapiens
caggtgcagctggtggagtctgggggaggcgtggtccagcctgggaggtccctgagactctcctgtgcagcgtctggattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 5945 - DNA, 296 bp, Homo sapiens
caggtgcagctggtggagtctggggggggcgtggtccagcctgggaggtccctgagactctcctgtgcagcgtctggattcaccttcagtagctatggcatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgaacagcctgagagccgaggacacggctgtgtattactgtgcgagaga

SEQ ID NO: 5946 - DNA, 296 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctagagtgggtggcagttatatcatatgatggaagtaataaatactacgcagactccgtgaagggccgattcaccatctccagagacaattccaagaacaggctgtatctgcaaatgaacagcctgagagctgaggacacggctgtgtattactgtgcgagaga

SEQ ID NO: 5947 - DNA, 296 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatcttcaaatgaacagcctgagagctgaggacacggctgtgtattactgtgcgagaga

SEQ ID NO: 5948 - DNA, 296 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctagagtgggtggcagttatatcatatgatggaagtaataaatactacgcagactccgtgaagggccgattcaccatctccagagacaattccaagaacacgctgtatctgcaaatgagcagcctgagagctgaggacacggctgtgtattactgtgcgagaga

SEQ ID NO: 5949 - DNA, 296 bp, Homo sapiens
caggtgcagctggtggagtctgggggaggcgtggtccagcctgggaggtccctgagactctcctgtgcagcctctggattcaccttcagtagctatgctatgcactgggtccgccaggccccaggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 5950 - DNA, 296 bp, Homo sapiens
caggtgcagctggtggagtctgggggaggcgtggtccagcctgggaggtccctgagactctcctgtgcagcctctggattcaccttcagtagctatgctatgcactgggtccgccaggctccgggcaaggggctagagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 5951 - DNA, 296 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaaga

SEQ ID NO: 5952 - DNA, 296 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaga

SEQ ID NO: 5953 - DNA, 294 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgaga

SEQ ID NO: 5954 - DNA, 296 bp, Homo sapiens
caggtgcagctggtggagtctgggggaggcgtggtccagcctgggaggtccctgagactctcctgtgcagcgtctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgaaaga

SEQ ID NO: 5955 - DNA, 298 bp, Homo sapiens
gaggtggagctgatagagtccatagaggacctgagacaacctgggaagttcctgagactctcctgtgtagcctctagattcgccttcagtagcttctgaatgagccgagttcaccagtctccaggcaaggggctggagtgagtaatagatataaaagatgatggaagtcagatacaccatgcagactctgtgaagggcagattctccatctccaaagacaatgctaagaactctctgtatctgcaaatgaacactcagagagctgaggacgtggccgtgtatggctatacataaggtc

SEQ ID NO: 5956 - DNA, 296 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaga

SEQ ID NO: 5957 - DNA, 296 bp, Homo sapiens
caggtacagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgcgaagggccgattcaccatctccagagacaattccacgaacacgctgtttctgcaaatgaacagcctgagagccgaggacacggctgtgtattactgtgcgagaga

SEQ ID NO: 5958 - DNA, 296 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaactccaagaacacgctgtatctgcaaatgaacagcctgagagccgaggacacggctgtgtattactgtgcgaaaga

SEQ ID NO: 5959 - DNA, 296 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagccgaggacacggctgtgtattactgtgcgagaga

SEQ ID NO: 5960 - DNA, 296 bp, Homo sapiens; identical to SEQ ID NO: 5959

SEQ ID NO: 5961 - DNA, 296 bp, Homo sapiens
gaggtgcagctggtggagtctgggggaggcttggtacagcctgggggatccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaa

SEQ ID NO: 5962 - DNA, 292 bp, Homo sapiens
gaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgcgtattactgtgccagatata

SEQ ID NO: 5963 - DNA, 292 bp, Homo sapiens
gaggtgcagctggtggagtctgggggaggcttggtacagcctagggggtccctgagactctcctgtgcagcctctggattcaccgtcagtagcaatgagatgagctggatccgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatata

SEQ ID NO: 5964 - DNA, 298 bp, Homo sapiens
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagata

SEQ ID NO: 5965 - DNA, 294 bp, Homo sapiens
gaagtgcagctggtggagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaa

SEQ ID NO: 5966 - DNA, 291 bp, Homo sapiens
gaggatcagctggtggagtctgggggaggcttggtacagcctggggggtccctgcgaccctcctgtgcagcctctggattcgccttcagtagctatgctctgcactgggttcgccgggctccagggaagggtctggagtgggtatcagctattggtactggtggtgatacatactatgcagactccgtgatgggccgattcaccatctccagagacaacgccaagaagtccttgtatcttcatatgaacagcctgatagctgaggacatggctgtgtattattgtgcaaga

SEQ ID NO: 5967 - DNA, 293 bp, Homo sapiens
gaggatcagctggtggagtctgggggaggcttggtacagcctggggggtccctgagaccctcctgtgcagcctctggattcgccttcagtagctatgttctgcactgggttcgccgggctccagggaagggtccggagtgggtatcagctattggtactggtggtgatacatactatgcagactccgtgatgggccgattcaccatctccagagacaacgccaagaagtccttgtatcttcaaatgaacagcctgatagctgaggacatggctgtgtattattgtgcaagaga

SEQ ID NO: 5968 - DNA, 282 bp, Homo sapiens
gaggatcagctggtggagtctgggggaggcttggtacagcctggggggtccctgagaccctcctgtgcagcctctggattcgccttcagtagctatgttctgcactgggttcgccgggctccagggaagggtccggagtgggtatcagctattggtactggtggtgatacatactatgcagactccgtgatgggccgattcaccatctccagagacaacgccaagaagtccttgtatctcaaatgaacagcctgatagctgaggacatggctgtgtattatg

SEQ ID NO: 5969 - DNA, 296 bp, Homo sapiens
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagccgaggacacggctgtgtattactgtgcgagaga

SEQ ID NO: 5970 - DNA, 296 bp, Homo sapiens
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagaga

SEQ ID NO: 5971 - DNA, 296 bp, Homo sapiens
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgcgagaga

SEQ ID NO: 5972 - DNA, 302 bp, Homo sapiens
gaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacaccgcgtctgtgaaaggcagattcaccatctcaagagatggttccaaaagcatcgcctatctgcaaatgaacagcctgaaaaccgaggacacagccgtgtattactgtactagaga

SEQ ID NO: 5973 - DNA, 302 bp, Homo sapiens
gaggtgcagctggtggagtctgggggaggcttggtacagccagggccgtccctgagactctcctgtacagcttctggattcacctttgggtattatcctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaga

SEQ ID NO: 5974 - DNA, 302 bp, Homo sapiens
gaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaga

SEQ ID NO: 5975 - DNA, 302 bp, Homo sapiens
gaggtgcagctggtggagtctgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaga

SEQ ID NO: 5976 - DNA, 302 bp, Homo sapiens
gaggtgcagctggtggagtctgggggaggcttggtaaagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaga

SEQ ID NO: 5977 - DNA, 296 bp, Homo sapiens
gaggtgcagctggtggagtctgggtgaggcttggtacagcctggagggtccctgagactctcctgtgcagcctctggattcaccttcagtagctcctggatgcactgggtctgccaggctccggagaaggggctggagtgggtggccgacataaagtgtgacggaagtgagaaatactatgtagactctgtgaagggccgattgaccatctccagagacaatgccaagaactccctctatctgcaagtgaacagcctgagagctgaggacatgaccgtgtattactgtgtgagagg

SEQ ID NO: 5978 - DNA, 294 bp, Homo sapiens
gaggtgcagctggtggagtctgggtgaggcttggtacagcctggagggtccctgagactctcctgtgcagcctctggattcaccttcagtagctcctggatgcactgggtctgccaggctccggagaaggggcaggagtgggtggccgacataaagtgtgacggaagtgagaaatactatgtagactctgtgaagggccgattgaccatctccagagacaatgccaagaactccctctatctgcaagtgaacagcctgagagctgaggacatgaccgtgtattactgtgtgaga

SEQ ID NO: 5979 - DNA, 294 bp, Homo sapiens
gaggtgcagctggtcgagtctgggtgaggcttggtacagcctggagggtccctgagactctcctgtgcagcctctggattcaccttcagtagctcctggatgcactgggtctgccaggctccggagaaggggctggagtgggtggccgacataaagtgtgacggaagtgagaaatactatgtagactctgtgaagggccgattgaccatctccagagacaatgccaagaactccctctatctgcaagtgaacagcctgagagctgaggacatgaccgtgtattactgtgtgaga

SEQ ID NO: 5980 - DNA, 293 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagaga

SEQ ID NO: 5981 - DNA, 291 bp, Homo sapiens
gaggtgcagctggtggagactggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgaga

SEQ ID NO: 5982 - DNA, 293 bp, Homo sapiens
gaggtgcagctggtggagtctggaggaggcttgatccagcctggggggtccctgagactctcctgtgcagcctctgggttcaccgtcagtagcaactacatgagctgggtccgccagcctccagggaaggggctggagtgggtctcagttatttatagcggtggtagcacatactacgcagactctgtgaagggccgattcaccatctccagagacaattccaagaacacgctgtatcttcaaatgaacagcctgagagccgaggacacggccgtgtattactgtgctaggga

SEQ ID NO: 5983 - DNA, 296 bp, Homo sapiens
gaggtacagctggtggagtctgaagaaaaccaaagacaacttgggggatccctgagactctcctgtgcagactctggattaaccttcagtagctactgaatgagctcagattcccaagctccagggaaggggctggagtgagtagtagatatatagtaggatagaagtcagctatgttatgcacaatctgtgaagagcagattcaccatctccaaagaaaatgccaagaactcactctgtttgcaaatgaacagtctgagagcagagggcacggccgtgtattactgtatgtgagy

SEQ ID NO: 5984 - DNA, 296 bp, Homo sapiens
gaggtacagctggtggagtctgaagaaaaccaaagacaacttgggggatccctgagactctcctgtgcagactctggattaaccttcagtagctactgaatgagctcagattcccaggctccagggaaggggctggagtgagtagtagatatatagtacgatagaagtcagatatgttatgcacaatctgtgaagagcagattcaccatctccaaagaaaatgccaagaactcactccgtttgcaaatgaacagtctgagagcagagggcacggccgtgtattactgtatgtgagg

SEQ ID NO: 5985 - DNA, 296 bp, Homo sapiens
gaggtacagctggtggagtctgaagaaaaccaaagacaacttgggggatccctgagactctcctgtgcagactctggattaaccttcagtagctactgaatgagctcagattcccaggctccagggaaggggctggagtgagtagtagatatatagtaggatagaagtcagctatgttatgcacaatctgtgaagagcagattcaccatctccaaagaaaatgccaagaactcactctgtttgcaaatgaacagtctgagagcagagggcacggccgtgtattactgtatgtgagt

SEQ ID NO: 5986 - DNA, 296 bp, Homo sapiens
gaggtgcagctggtggagtctggggaaggcttggtccagcctggggggtccctgagactctcctgtgcagcctctggattcaccttcagtagctctgctatgcactgggtccgccaggctccaagaaagggtttgtagtgggtctcagttattagtacaagtggtgataccgtactctacacagactctgtgaagggccgattcaccatctccagagacaatgcccagaattcactgtctctgcaaatgaacagcctgagagccgagggcacagttgtgtactactgtgtgaaaga

SEQ ID NO: 5987 - DNA, 298 bp, Homo sapiens
gaggtggagctgatagagtccatagagggcctgagacaacttgggaagttcctgagactctcctgtgtagcctctggattcaccttcagtagctactgaatgagctgggtcaatgagactctagggaaggggctggagggagtaatagatgtaaaatatgatggaagtcagatataccatgcagactctgtgaagggcagattcaccatctccaaagacaatgctaagaactcaccgtatctccaaacgaacagtctgagagctgaggacatgaccatgcatggctgtacataaggtt

SEQ ID NO: 5988 - DNA, 294 bp, Homo sapiens
gaggtggagctgatagagtccatagagggcctgagacaacttgggaagttcctgagactctcctgtgtagcctctggattcaccttcagtagctactgaatgagctgggtcaatgagactctagggaaggggctggagggagtaatagatgtaaaatatgatggaagtcagatataccatgcagactctgtgaagggcagattcaccatctccaaagacaatgctaagaactcaccgtatctgcaaacgaacagtctgagagctgaggacatgaccatgcatggctgtacataa

SEQ ID NO: 5989 - DNA, 296 bp, Homo sapiens
gaggtgcagctggtggagtctgggggaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaga

SEQ ID NO: 5990 - DNA, 296 bp, Homo sapiens
gaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagaga

SEQ ID NO: 5991 - DNA, 296 bp, Homo sapiens
gaggtgcagctggtggagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatgtccaaatgagcagtctgagagctgaggacacggctgtgtattactgtgtgaaaga

SEQ ID NO: 5992 - DNA, 296 bp, Homo sapiens
caggtgcagctggtggagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatctgcaaatgaacagcctgagagctgaggacacggctgtgtattactgtgcgagaga

SEQ ID NO: 5993 - DNA, 296 bp, Homo sapiens
gaggtgcagctggtggagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatgttcaaatgagcagtctgagagctgaggacacggctgtgtattactgtgtgaaaga

SEQ ID NO: 5994 - DNA, 293 bp, Homo sapiens
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggcagattcaccatctccagagacaattccaagaacacgctgtatcttcaaatgaacagcctgagagccgaggacacggctgtgtattactgtgcgagaga

SEQ ID NO: 5995 - DNA, 291 bp, Homo sapiens
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgaga

SEQ ID NO: 5996 - DNA, 293 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgcgagaga

SEQ ID NO: 5997 - DNA, 293 bp, Homo sapiens
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggcagattcaccatctccagagacaattccaagaacacgctgtatcttcaaatgaacagcctgagagccgaggacacggctgtgtattactgtgcgagaca

SEQ ID NO: 5998 - DNA, 296 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagaga

SEQ ID NO: 5999 - DNA, 294 bp, Homo sapiens
gaggtgcagctggtggagtctgggggaggcttggtccagcctggggggtccctgagactctcctgtgcagcctctggattcacctttagtagctattggatgagctgggtccgccaggctccagggaaagggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgaga

SEQ ID NO: 6000 - DNA, 302 bp, Homo sapiens
gaggtgcagctggtggagtccgggggaggcttggtccagcctggggggtccctgagactctcctgtgcagcctctggattcaccttcagtgactactacatgagctgggtccgccaggctcccgggaaggggctggagtgggtaggtttcattagaaacaaagctaatggtgggacaacagaatagaccacgtctgtgaaaggcagattcacaatctcaagagatgattccaaaagcatcacctatctgcaaatgaacagcctgagagccgaggacacggccgtgtattactgtgcgagaga

SEQ ID NO: 6001 - DNA, 302 bp, Homo sapiens
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagaga

SEQ ID NO: 6002 - DNA, 165 bp, Homo sapiens
accttcagtgaccactacatggactgggtccgccaggctccagggaaggggctggagtgggttggccgtactagaaacaaagctaacagctacaccacagaatacgccgcgtctgtgaaaggcagattcaccatctcaagagatgattcaaagaactcactgtat

SEQ ID NO: 6003 - DNA, 302 bp, Homo sapiens
gaggtgcagctggtggagtctgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagaca

SEQ ID NO: 6004 - DNA, 302 bp, Homo sapiens
gaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagaca

SEQ ID NO: 6005 - DNA, 296 bp, Homo sapiens
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagaga

SEQ ID NO: 6006 - DNA, 294 bp, Homo sapiens
gaggtgcagctggtggagtctgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaaga

SEQ ID NO: 6007 - DNA, 296 bp, Homo sapiens
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaacgtacgcggactccgtgaagggccgattcaccatctccagagacaacgccaagaacacgctgtatctgcaaatgaacagtctgagagccgaggacacggctgtgtattactgtgcaagaga

SEQ ID NO: 6008 - DNA, 298 bp, Homo sapiens
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagata

SEQ ID NO: 6009 - DNA, 288 bp, Homo sapiens
gaggtgcagctggtggagtctcggggagtcttggtacagcctggggggtccctgagactctcctgtgcagcctctggattcaccgtcagtagcaatgagatgagctgggtccgccaggctccagggaagggtctggagtgggtctcatccattagtggtggtagcacatactacgcagactccaggaagggcagattcaccatctccagagacaattccaagaacacgctgcatcttcaaatgaacagcctgagagctgaggacacggctgtgtattactgtaagaaa

SEQ ID NO: 6010 - DNA, 293 bp, Homo sapiens
gaggtgcagctggtggagtctgggggaggcttggtaaagcctggggggtccctgagactctcctgtgcagcctctggattcaccttcagtgactactacatgaactgggtccgccaggctccagggaaggggctggagtgggtctcatccattagtagtagtagtaccatatactacgcagactctgtgaagggccgattcaccatctccagagacaacgccaagaactcactgtatctgcaaatgaacagcctgagagccgaggacacggctgtgtattactgtgcgagaga

SEQ ID NO: 6011 - DNA, 293 bp, Homo sapiens
gaggtgcagctggtggagtctgggggaggcttggtaaagcctggggggtccctgagactctcctgtgcagcctctggattcaccttcagtgactactacatgaactgggtccgccaggctccagggaaggggctggagtgggtctcatccattagtagtagtagtaccatatactacgcagactctgtgaagggccgattcaccatctccagagacaacgccaagaactcactgtatctgcaaatgaacagcctgagagccgaggacacggctgtttattactgtgcgagaga

SEQ ID NO: 6012 - DNA, 300 bp, Homo sapiens
gaggtgcagctggtggagtctgggggaggcttggtccagcctgggggttctctgagactctcatgtgcagcctctggattcaccttcagtgaccactacatgagctgggtccgccaggctcaagggaaagggctagagttggtaggtttaataagaaacaaagctaacagttacacgacagaatatgctgcgtctgtgaaaggcagacttaccatctcaagagaggattcaaagaacacgatgtatctgcaaatgagcaacctgaaaaccgaggacttggccgtgtattactgtgctaga

SEQ ID NO: 6013 - DNA, 300 bp, Homo sapiens
gaggtgcagctgttggagtctgggggaggcttggtccagcctgggggttctctgagactctcatgtgctgcctctggattcaccttcagtgaccactacatgagctgggtccgccaggctcaagggaaagggctagagttggtaggtttaataagaaacaaagctaacagttacacgacagaatatgctgcgtctgtgaaaggcagacttaccatctcaagagaggattcaaagaacacgctgtatctgcaaatgagcagcctgaaaaccgaggacttggccgtgtattactgtgctaga

SEQ ID NO: 6014 - DNA, 300 bp, Homo sapiens
gaggtgcagctggtggagtctgggggaggcttggtccagcctgggggttctctgagactctcatgtgcagcctctggattcaccttcagtgaccactacatgagctgggtccgccaggctcaagggaaagggctagagttggtaggtttaataagaaacaaagctaacagttacacgacagaatatgctgcgtctgtgaaaggcagacttaccatctcaagagaggattcaaagaacacgctgtatctgcaaatgagcagcctgaaaaccgaggacttggccgtgtattactgtgctaga

SEQ ID NO: 6015 - DNA, 291 bp, Homo sapiens
gaggttcagctggtgcagtctgggggaggcttggtacatcctggggggtccctgagactctcctgtgcaggctctggattcaccttcagtagctatgctatgcactgggttcgccaggctccaggaaaaggtctggagtgggtatcagctattggtactggtggtggcacatactatgcagactccgtgaagggccgattcaccatctccagagacaatgccaagaactccttgtatcttcaaatgaacagcctgagagccgaggacatggctgtgtattactgtgcaaga

SEQ ID NO: 6016 - DNA, 291 bp, Homo sapiens
gaggttcagctggtgcagtctgggggaggcttggtacagcctggggggtccctgagactctcctgtgcaggctctggattcaccttcagtagctatgctatgcactgggttcgccaggctccaggaaaaggtctggagtgggtatcagctattggtactggtggtggcacatactatgcagactccgtgaagggccgattcaccatctccagagacaatgccaagaactccttgtatcttcaaatgaacagcctgagagccgaggacatggctgtgtattactgtgcaaga

SEQ ID NO: 6017 - DNA, 294 bp, Homo sapiens
gaggtgcagctggtagagtctgggagaggcttggcccagcctggggggtacctaaaactctccggtgcagcctctggattcaccgtcggtagctggtacatgagctggatccaccaggctccagggaagggtctggagtgggtctcatacattagtagtagtggttgtagcacaaactacgcagactctgtgaagggcagattcaccatctccacagacaactcaaagaacacgctctacctgcaaatgaacagcctgagagtggaggacacggccgtgtattactgtgcaaga

SEQ ID NO: 6018 - DNA, 294 bp, Homo sapiens
gaggtgcagctggtggagtctgggggaggcttagtacagcctggagggtccctgagactctcctgtgcagcctctggattcaccttcagtagctactggatgcactgggtccgccaagctccagggaaggggctggtgtgggtctcacgtattaatagtgatgggagtagcacaagctacgcagactccatgaagggccaattcaccatctccagagacaatgctaagaacacgctgtatctgcaaatgaacagtctgagagctgaggacatggctgtgtattactgtactaga

SEQ ID NO: 6019 - DNA, 294 bp, Homo sapiens
gaggtgcagctggaggagtctgggggaggcttagtacagcctggagggtccctgagactctcctgtgcagcctctggattcaccttcagtagctactggatgcactgggtccgccaatctccagggaaggggctggtgtgagtctcacgtattaatagtgatgggagtagcacaagctacgcagactccttgaagggccaattcaccatctccagagacaatgctaagaacacgctgtatctgcaaatgaacagtctgagagctgaggacatggctgtgtattactgtactaga

SEQ ID NO: 6020 - DNA, 296 bp, Homo sapiens
gaagtgcagctggtggagtctgggggaggcttggtccagcctggggggtccctgagactctcctgtgcagcctctgtattcaccttcagtaacagtgacataaactgggtcctctaggctccaggaaaggggctggagtgggtctcgggtattagttggaatggcggtaagacgcactatgtggactccgtgaagggccaattttccatctccagagacaattccagcaagtccctgtatctgcaaaagaacagacagagagccaaggacatggccgtgtattactgtgtgagaaa

SEQ ID NO: 6021 - DNA, 294 bp, Homo sapiens
gaggtgcagctggtggagtctgggggaggcttggtccagcctggggggtccctgagacactcctgtgcagcctctggattcaccttcagtaacagtgacatgaactgggtcctctaggctccaggaaaggggctggagtgggtctcgggtattagttggaatggcggtaagacgcactatgtggactccgtgaagggccaatttaccatctccagagacaattccagcaagtccctgtatctgcaaaagaacagacagagagccaaagacatggccgtgtattactgtgtgaga

SEQ ID NO: 6022 - DNA, 294 bp, Homo sapiens
gaggtgcagctggtggagtctgggggaggcttggtccagcctggggggtccctgagacactcctgtgcagcctctggattcaccttcagtaacagtgacatgaactgggtcctctaggctccaggaaaggggctggagtgggtctcggatattagttggaatggcggtaagacgcactatgtggactccgtgaagggccaatttaccatctccagagacaattccagcaagtccctgtatctgcaaaagaacagacagagagccaaggacatggccgtgtattactgtgtgaga

SEQ ID NO: 6023 - DNA, 292 bp, Homo sapiens
gaggtgcagctggtggagtctgggggaggcttggtacagcctggggggtccctgagactgtcctgtccagcctctggattcaccttcagtaaccactacatgagctgggtccgccaggctccagggaagggactggagtgggtttcatacattagtggtgatagtggttacacaaactacgcagactctgtgaagggccgattcaccatctccagggacaacgccaataactcaccgtatctgcaaatgaacagcctgagagctgaggacacggctgtgtattactgtgtga

SEQ ID NO: 6024 - DNA, 292 bp, Homo sapiens
gaggtgcagctggtggagtctggaggaggcttggtacagcctggggggtccctgagactctcctgtgcagcctctggattcaccttcagtaaccactacacgagctgggtccgccaggctccagggaagggactggagtgggtttcatacagtagtggtaatagtggttacacaaactacgcagactctgtgaaaggccgattcaccatctccagggacaacgccaagaactcactgtatctgcaaatgaacagcctgagagccgaggacacggctgtgtattactgtgtga

SEQ ID NO: 6025 - DNA, 296 bp, Homo sapiens
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaa

SEQ ID NO: 6026 - DNA, 296 bp, Homo sapiens
caggtgcagctgcaggagtcgggcccaggactggtgaagccttcacagaccctgtccctcacctgcgctgtctctggttactccatcagcagtagtaactggtggggctggatccggcagcccccagggaagggactggagtggattgggtacatctattatagtgggagcatctactacaacccgtccctcaagagtcgagtcaccatgtcagtagacacgtccaagaaccagttctccctgaagctgagctctgtgaccgccgtggacacggccgtgtattactgtgcgagaaa

SEQ ID NO: 6027 - DNA, 296 bp, Homo sapiens
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaga

SEQ ID NO: 6028 - DNA, 294 bp, Homo sapiens
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacaccggcgtgtattactgtgcgaga

SEQ ID NO: 6029 - DNA, 287 bp, Homo sapiens
caggtgcagctgcaggagtcgggcccaggactggtgaagccttcggacaccctgtccctcacctgcgctgtctctggttactccatcagcagtagtaactggtggggctggatccggcagcccccagggaagggactggagtggattgggtacatctattatagtgggagcatctactacaacccgtccctcaagagtcgagtcaccatgtcagtagacacgtccaagaaccagttctccctgaagctgagctctgtgaccgccgtggacacggccgtgtattactg

SEQ ID NO: 6030 - DNA, 299 bp, Homo sapiens
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggccgtgtattactgtgccagaga

SEQ ID NO: 6031 - DNA, 294 bp, Homo sapiens
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgctgcggacacggccgtgtattactgtgcg

SEQ ID NO: 6032 - DNA, 299 bp, Homo sapiens
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggagtatctattatagtgggagcacctactacaacccgtccctcaagagtcgagtcaccatatccgtagacacgtccaagaaccagttctccctgaagctgagctctgtgaccgctgcagacacggctgtgtattactgtgcgagaca

SEQ ID NO: 6033 - DNA, 227 bp, Homo sapiens
tctggtggctccatcagcagtggtggttactcctggagctggatccggcagccaccagggaagggcctggagtggattgggtacatctatcatagtgggagcacctactacaacccgtccctcaagagtcgagtcaccatatcagtagacacgtccaagaaccagttctccctgaagctgagctctgtgaccgccgcagacacggccgtgtattactgtgcgagaga

SEQ ID NO: 6034 - DNA, 299 bp, Homo sapiens
caggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccagaga

SEQ ID NO: 6035 - DNA, 299 bp, Homo sapiens
caggtgcagctgcaggagtcgggcccaggactggtgaagccttcggacaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgcagcagacacggccgtgtattactgtgccagaga

SEQ ID NO: 6036 - DNA, 290 bp, Homo sapiens
caggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcggacacggccgtgtattactg

SEQ ID NO: 6037 - DNA, 290 bp, Homo sapiens
caggtgcagctgcaggactcgggcccaggactggtgaagccttcacagaccctgtccctcacctgcactgtctctggtggctccatcagcagtggtgattactactggagttggatccgccagcccccagggaagggcctggagtggattgggtacttctattacagtgggagcacctactacaacccgtccctcaagagtcgagttaccatatcagtagacacgtccaagaaccagttctccctgaagctgagctctgtgactgccgcagacacggccgtgtattactg

SEQ ID NO: 6038 - DNA, 228 bp, Homo sapiens
  misc_feature (54)..(54): n = A, T, C or G
ctctggtggctccatcagcagtggtgattactactggagttggatccgccagcncccagggaagggcctggagtggattgggtacatctattacagtgggagcacctactacaacccgtccctcaagagtcgagtcaccatatcagtagacacgtccaagaaccagttctccctgaagctgagctctgtgactgccgcagacacggccgtgtattactgtgccagaga

SEQ ID NO: 6039 - DNA, 227 bp, Homo sapiens
tctggtggctccatcagcagtggtgattactactggagttggatccgccagcacccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccagaga

SEQ ID NO: 6040 - DNA, 299 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtctagttaccatatcagtagacacgtctaagaaccagttctccctgaagctgagctctgtgactgccgcggacacggccgtgtattactgtgcgagaga

SEQ ID NO: 6041 - DNA, 299 bp, Homo sapiens
caggtgcagctgcaggagtcgggcccaggactggtgaagccttcacagaccctgtccctcacctgtactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaga

SEQ ID NO: 6042 - DNA, 299 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaga

SEQ ID NO: 6043 - DNA, 294 bp, Homo sapiens
caggtgcggctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcg

SEQ ID NO: 6044 - DNA, 291 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgaccgcggacgcggccgtgtattactgtgcg

SEQ ID NO: 6045 - DNA, 290 bp, Homo sapiens
caggtgcagctgcaggagtcgggcccaggactggtgaagccttcacagaccctgtccctcacctgcactgtctctggtggctccatcagcagtggtagttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactg

SEQ ID NO: 6046 - DNA, 290 bp, Homo sapiens
caggtgcagctgcaggagtcgggcccaggactggtgaagccttcacagaccctgtccctcacctgcactgtctctggtggatccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactg

SEQ ID NO: 6047 - DNA, 290 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatccgtagacacgtccaagaaccagttctccctgaagctgagctctgtgactgccgcggacacggccgtgtattactg

SEQ ID NO: 6048 - DNA, 290 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacaagtccaagaaccagttctccctgaagctgagctctgtgaccgccgcggacacggccgtgtattactg

SEQ ID NO: 6049 - DNA, 299 bp, Homo sapiens
caggtgcagctgcaggagtcgggcccaggactgttgaagccttcacagaccctgtccctcacctgcactgtctctggtggctccatcagcagtggtggttactactggagctggatccgccagcacccagggaagggcctggagtggattgggtgcatctattacagtgggagcacctactacaacccgtccctcaagagtcgagttaccatatcagtagacccgtccaagaaccagttctccctgaagccgagctctgtgactgccgcggacacggccgtggattactgtgcgagaga

SEQ ID NO: 6050 - DNA, 293 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagg

SEQ ID NO: 6051 - DNA, 293 bp, Homo sapiens
caggtgcagctacaacagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagg

SEQ ID NO: 6052 - DNA, 284 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactg

SEQ ID NO: 6053 - DNA, 293 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaacaacaacccgtccctcaagagtcgagccaccatatcagtagacacgtccaagaaccagttctccctgaagctgagctctgtgaccgccgcggacacggctgtgtattactgtgcgagagg

SEQ ID NO: 6054 - DNA, 293 bp, Homo sapiens
caggtgcagctacagcagtggggcgcaggactgttgaagccttcggagaccctgtccctcacctgcgctgtctatggtgggtccttcagtggttactactggtgctggatccgccagcccctagggaaggggctggagtggattggggaaatcaatcatagtggaagcaccaacaacaacccgtccctcaagagtcgagccaccatatcagtagacacgtccaagaaccagttctccctgaagctgagctctgtgaccgccgcggacacggctgtgtattactgtgcgagagg

SEQ ID NO: 6055 - DNA, 284 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgggctctgtgaccgccgcggacacggccgtgtattactg

SEQ ID NO: 6056 - DNA, 284 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaaccatagtggaagcaccaactacaacccgtccctcaagagtcgagtcaccatatcagtagacacgtccaagaaccagttctccctgaagctgagctctgtgaccgccgcggacacggccgtgtattactg

SEQ ID NO: 6057 - DNA, 288 bp, Homo sapiens
caggtgcagctacagcagtggggcgcaggactgttgaagccttcggagaccctgtccctcacctgcgctgtctatggtgggaccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcg

SEQ ID NO: 6058 - DNA, 293 bp, Homo sapiens
caggtgcagctgcaggagtcgggcccaggactggtgaagccttcacagaccctgtccctcacctgcgctgtctatggtgggtccttcagtggttactactggagctggatccgccagcccccagggaagggactggagtggattggggaaatcaatcatagtggaagcaccaactacaacccgtccctcaagagtcgagttaccatatcagtagacacgtctaagaaccagttctccctgaagctgagctctgtgactgccgcggacacggccgtgtattactgtgcgagaga

SEQ ID NO: 6059 - DNA, 293 bp, Homo sapiens
caggtgcagctgcaggagtcgggcccaggactggtgaagccttcggagaccctgtccctcacctgcgctgtctatggtgggtccttcagtggttactactggagctggatccgccagcccccagggaagggactggagtggattggggaaatcaatcatagtggaagcaccaactacaacccgtccctcaagagtcgaatcaccatgtcagtagacacgtccaagaaccagttctacctgaagctgagctctgtgaccgccgcggacacggccgtgtattactgtgcgagata

SEQ ID NO: 6060 - DNA, 293 bp, Homo sapiens
caggtgcagctacagcagtggggcgcaggactgttgaagccttcggagaccctgtccctcacctgcgctgtctatggtgggtccgtcagtggttactactggagctggatccggcagcccccagggaaggggctggagtggattgggtatatctattatagtgggagcaccaacaacaacccctccctcaagagtcgagccaccatatcagtagacacgtccaagaaccagttctccctgaacctgagctctgtgaccgccgcggacacggccgtgtattgctgtgcgagaga

SEQ ID NO: 6061 - DNA, 291 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcattcatagtggaagcaccaactacaacccgtccctcaagagtcgagtcaccatatcagtagacacgtccaagaaccagttctccctgaagctgagctctgtgaccgccgcggacacggctgtgtattactgtgcgaga

SEQ ID NO: 6062 - DNA, 221 bp, Homo sapiens
tatggtgggtccttcagtggttactactggagctggatccgccagcccccagggaaggggctggagtggattggggaaatcaatcatagtggaagcaccaactacaacccctccctcaagagtcgagtcaccatatcagtagacacgtccaagaaccagttctccctgaagctgagctctgtgaccgccgcggacacggctgtgtattactgtgcgagagg

SEQ ID NO: 6063 - DNA, 299 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagaca

SEQ ID NO: 6064 - DNA, 299 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccacttctccctgaagctgagctctgtgaccgccgcagacacggctgtgtattactgtgcgagaga

SEQ ID NO: 6065 - DNA, 290 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggccgtgtattactg

SEQ ID NO: 6066 - DNA, 196 bp, Homo sapiens
gctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcggacac

SEQ ID NO: 6067 - DNA, 294 bp, Homo sapiens
cagctgcagctgcaggagtcgggcccaggactggtgaagccttcggagaccccgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcg

SEQ ID NO: 6068 - DNA, 299 bp, Homo sapiens
cggctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttccccctgaagctgagctctgtgaccgccgcggacacggccgtgtattactgtgcgagaga

SEQ ID NO: 6069 - DNA, 299 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagaga

SEQ ID NO: 6070 - DNA, 296 bp, Homo sapiens
caggtgcagctgcaggagtcgggcccaggactggtgaagcctccggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattgctgtgcgagaga

SEQ ID NO: 6071 - DNA, 296 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagaga

SEQ ID NO: 6072 - DNA, 287 bp, Homo sapiens
caggtgcagctgcaggagtcgggcccaggactggtgaagcctccggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactg

SEQ ID NO: 6073 - DNA, 287 bp, Homo sapiens
caggtgcagctgcaggagtcgggcccaggactggtgaagcctccggggaccctgtccctcacctgcgctatctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactg

SEQ ID NO: 6074 - DNA, 287 bp, Homo sapiens
caggtgcagctgcaggagttgggcccaggactggtgaagcctccggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactg

SEQ ID NO: 6075 - DNA, 224 bp, Homo sapiens
  misc_feature (59)..(61): n = A, T, C or G
tctggtggctccatcagcagtagtaactggtggagttgggtccgccagcccccagggannnggctggagtggattggggaaatctatcatagtgggagcaccaactacaacccgtccctcaagagtcgagtcaccatgtcagtagacacgtccaagaaccagttctccctgaagctgagctctgtgaccgccgcggacacggccgtgtattactgtgcgagaga

SEQ ID NO: 6076 - DNA, 293 bp, Homo sapiens
caggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagaga

SEQ ID NO: 6077 - DNA, 296 bp, Homo sapiens
caggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtccgtagacacgtccaagaaccagttctacctgaagctgagctctgtgaccgccgcggacacggccgtgtattactgtgcgagata

SEQ ID NO: 6078 - DNA, 296 bp, Homo sapiens
caggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtcagtagacacgtccaagaaccagttctacctgaagctgagctctgtgaccgccgcggacacggccgtgtattactgtgcgagata

SEQ ID NO: 6079 - DNA, 287 bp, Homo sapiens
caggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtcagtagacacgtccaagaaccagttctccctgaagctgagctctgtgaccgccgcggacacggccgtgtattactg

SEQ ID NO: 6080 - DNA, 287 bp, Homo sapiens
caggtgcagctgcaggagtcgggcccaggactggtgaagctttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtcagtagacacgtccaagaaccagttctacctgaagctgagctctgtgaccgccgcggacacggccgtgtattactg

SEQ ID NO: 6081 - DNA, 287 bp, Homo sapiens
caggtgcagctgcaggagtcgggcccaggactggtgaagctttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtccgtagacacgtccaagaaccagttctacctgaagctgagctctgtgaccgccgcggacacggccgtgtattactg

SEQ ID NO: 6082 - DNA, 287 bp, Homo sapiens
caggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtccgtagacacgtccaagaagcagttctacctgaagctgagctctgtgaccgctgcggacacggccgtgtattactg

SEQ ID NO: 6083 - DNA, 286 bp, Homo sapiens
caggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtccgtagacacgtccaggaaccagttctccctgaagctgagctctgtgaccgccgcagacacggccgtgtattact

SEQ ID NO: 6084 - DNA, 296 bp, Homo sapiens
caggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtcagtagacacgtccaagaaccagttctacctgaagctgagctctgtgaccgccgcggacacggccgtgtattactgtgcgagaga

SEQ ID NO: 6085 - DNA, 296 bp, Homo sapiens
caggtgcagctgcaggagtcgggcccaggactggtgaagccttcggagaccctgtccctcatctgcgctgtctctggtgactccatcagcagtggtaactggtgaatctgggtccgccagcccccagggaaggggctggagtggattggggaaatccatcatagtgggagcacctactacaacccgtccctcaagagtcgaatcaccatgtccgtagacacgtccaagaaccagttctccctgaagctgagctctgtgaccgccgtggacacggccgtgtattactgtgcgagaaa

SEQ ID NO: 6086 - DNA, 293 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 6087 - DNA, 293 bp, Homo sapiens
caggtgcagctgcaggagtcgggcccaggactggtgaagccttcggagaccctgtccctcacctgcactgtctctggtggctccgtcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 6088 - DNA, 288 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccaattctccctgaagctgagctctgtgaccgctgcggacacggccgtgtattactgtgcg

SEQ ID NO: 6089 - DNA, 288 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattatagtgggagcacctactacaacccgtccctcaagagtcgagtcaccatgtcagtagacacgtccaagaaccagttctccctgaagctgagctctgtgaccgccgcagacacggctgtgtattactgtgcg

SEQ ID NO: 6090 - DNA, 288 bp, Homo sapiens
caggtgcagctgcaggagtcgggcccaggactggtgaagccttcggagaccctgtccctcacctgcactgtctctggtggctccatcagtagttactactggagctggatccggcagccgccggggaagggactggagtggattgggcgtatctattatagtgggagcacctactacaacccgtccctcaagagtcgagtcaccatatccgtagacacgtccaagaaccagttctccctgaagctgagctctgtgaccgccgcagacacggctgtgtattactgtgcg

SEQ ID NO: 6091 - DNA, 288 bp, Homo sapiens
caggtgcagctgcaggagtcgggcccaggactggtgaagccttcggagaccctgtccctcacctgcactgtcactggtggctccatcagtagttactactggagctggatccggcagcccgctgggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcg

SEQ ID NO: 6092 - DNA, 291 bp, Homo sapiens
caggtgcagctgcaggagtcgggcccaggactggtgaagccttcggacaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgaga

SEQ ID NO: 6093 - DNA, 237 bp, Homo sapiens
  misc_feature (36)..(214): n = A, T, C or G
tccctcacctgcactgtctctggtggctccatcagnagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgccgcagacncggccgtgtattactgtgcgaga

SEQ ID NO: 6094 - DNA, 221 bp, Homo sapiens
  misc_feature (54)..(54): n = A, T, C or G
  misc_feature (56)..(58): n = A, T, C or G
tctggtggctccatcagtagttactactggagctggatccggcagcccccaggnannngactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagg

SEQ ID NO: 6095 - DNA, 293 bp, Homo sapiens
caggtgcagctacagcagtggggcgcaggactgttgaagccttcggagaccctgtccctcacctgcgctgtctatggtggctccatcagtagttactactggagctggatccggcagcccgccgggaaggggctggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagata

SEQ ID NO: 6096 - DNA, 299 bp, Homo sapiens
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 6097 - DNA, 299 bp, Homo sapiens
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccagttctccctgaagctgagctctgtgaccgccgcagacacggccgtgtattactgtgcgagaga

SEQ ID NO: 6098 - DNA, 299 bp, Homo sapiens
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccacttctccctgaagctgagctctgtgaccgctgcggacacggccgtgtattactgtgcgagaga

SEQ ID NO: 6099 - DNA, 287 bp, Homo sapiens
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattggatatatctattacagtgggagcaccaactacaacccctccctcaagagtcgagtcaccatatcagtagacacgtccaagaaccagttctccctgaagctgagctctgtgaccgctgacacggccgtgtattactg

SEQ ID NO: 6100 - DNA, 297 bp, Homo sapiens
cagctgcagctgcaggagtcgggcccaggactggtgaagccttcggagaccctgtccctcacctgcactgtctctggtggctccatcagcagtagtagttactactggggctggatccggcagcccccagggaagggactggagtggattgggtatatctattacagtgggagcaccaactacaacccctccctcaagagtcgagtcaccatatcagtagacaagtccaagaaccagttctccctgaagctgagctctgtgaccgccgcggacacggccgtgtattactgtgcgaga

SEQ ID NO: 6101 - DNA, 227 bp, Homo sapiens
tctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgccgcggacacggccgtgtattactgtgccagaga

SEQ ID NO: 6102 - DNA, 227 bp, Homo sapiens
tctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaca

SEQ ID NO: 6103 - DNA, 299 bp, Homo sapiens
caggtgcagctgcaggagtcgggcccaggactggtgaagccttcggagaccctgtccctcacctgcactgtctctggtggctccgtcagcagtggtggttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 6104 - DNA, 294 bp, Homo sapiens
caggtgcagctgcaggagtcgggcccaggactggtgaagccttcggagaccctgtccctcacctgcgctgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgaga

SEQ ID NO: 6105 - DNA, 294 bp, Homo sapiens
caggtgcagctgcaggagtcgggcccaggactggtgaagccttcggagaccctgtccctcacctgcactgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgaga

SEQ ID NO: 6106 - DNA, 296 bp, Homo sapiens
caggtgcagctgcaggagtcgggcccaggactggtgaagccttcggagaccctgtccctcacctgcgttgtctctggtggctccatcagcagtagtaactggtggagctgggtccgccagcccccagggaaggggctggagtggattggggaaatctatcatagtgggaaccccaactacaacccgtccctcaagagtcgagtcaccatatcaatagacaagtccaagaaccaattctccctgaagctgagctctgtgaccgccgcggacacggccgtgtattactgtgcgagaga

SEQ ID NO: 6107 - DNA, 296 bp, Homo sapiens
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaca

SEQ ID NO: 6108 - DNA, 296 bp, Homo sapiens
gaggtgcagctggtgcagtctggagcagaggtgaaaaagcccggggagtctctgaagatctcctgtaagggttctggatacagctttaccagctactggaccggctgggtgcgccagatgcccgggaaaggcttggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaca

SEQ ID NO: 6109 - DNA, 294 bp, Homo sapiens
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaga

SEQ ID NO: 6110 - DNA, 294 bp, Homo sapiens
gaggtgcagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagcccatcagcaccgcctacctgcagtggagcagcctgaaggcctcggacaccgccatgtattactgtgcgaga

SEQ ID NO: 6111 - DNA, 245 bp, Homo sapiens
aaaagcccggggagtctctgaagatctcctgtaagggttctggatacagctttaccagctactggatcggctgggtgcgccagatgcccaggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatg

SEQ ID NO: 6112 - DNA, 294 bp, Homo sapiens
gaggtgcagctgttgcagtctgcagcagaggtgaaaagacccggggagtctctgaggatctcctgtaagacttctggatacagctttaccagctactggatccactgggtgcgccagatgcccgggaaagaactggagtggatggggagcatctatcctgggaactctgataccagatacagcccatccttccaaggccacgtcaccatctcagccgacagctccagcagcaccgcctacctgcagtggagcagcctgaaggcctcggacgccgccatgtattattgtgtgaga

SEQ ID NO: 6113 - DNA, 294 bp, Homo sapiens
gaagtgcagctggtgcagtctggagcagaggtgaaaaagcccggggagtctctgaggatctcctgtaagggttctggatacagctttaccagctactggatcagctgggtgcgccagatgcccgggaaaggcctggagtggatggggaggattgatcctagtgactcttataccaactacagcccgtccttccaaggccacgtcaccatctcagctgacaagtccatcagcactgcctacctgcagtggagcagcctgaaggcctcggacaccgccatgtattactgtgcgaga

SEQ ID NO: 6114 - DNA, 295 bp, Homo sapiens
gaagtgcagctggtgcagtctggagcagaggtgaaaaagcccggggagtctctgaggatctcctgtaagggttctggatacagctttaccagctactggatcagctgggtgcgccagatgcccgggaaaggcttggagtggatggggaggattgatcctagtgactcttataccaactacagcccgtccttccaaggccacgtcaccatctcagctgacaagtccatcagcactgcctacctgcagtggagcagcctgaaggctcggacaccgccatgtattactgtgcgagaca

SEQ ID NO: 6115 - DNA, 294 bp, Homo sapiens
gaagtgcagctggtgcagtccggagcagaggtgaaaaagcccggggagtctctgaggatctcctgtaagggttctggatacagctttaccagctactggatcagctgggtgcgccagatgcccgggaaaggcctggagtggatggggaggattgatcctagtgactcttataccaactacagcccgtccttccaaggccacgtcaccatctcagctgacaagtccatcagcactgcctacctgcagtggagcagcctgaaggcctcggacaccgccatgtattactgtgcgaga

SEQ ID NO: 6116 - DNA, 294 bp, Homo sapiens
gaagtgcagctggtgcagtctggagcagaggtgaaaaagcccggggagtctctgaggatctcctgtaagggttctggatacagctttaccagctactggatcagctgggtgcgccagatgcccgggaaaggcctggagtggatggggaggattgatcctagtgactcttataccaactacagcccgtccttccaaggccaggtcaccatctcagctgacaagtccatcagcactgcctacctgcagtggagcagcctgaaggcctcggacaccgccatgtattactgtgcgaga

SEQ ID NO: 6117 - DNA, 305 bp, Homo sapiens
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagaga

SEQ ID NO: 6118 - DNA, 305 bp, Homo sapiens
caggtacagctgcagcagtcaggtccgggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagaga

SEQ ID NO: 6119 - DNA, 294 bp, Homo sapiens
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatctgcagcctaaaggctgaggacactgccgtgtattactgtgcgaga

SEQ ID NO: 6120 - DNA, 296 bp, Homo sapiens
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccgtgtattactgtgcgagaga

SEQ ID NO: 6121 - DNA, 274 bp, Homo sapiens
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcacgctaaaggctgaggacactg

SEQ ID NO: 6122 - DNA, 289 bp, Homo sapiens
ctgcagctggtgcagtctgggcctgaggtgaagaagcctggggcctcagtgaaggtctcctataagtcttctggttacaccttcaccatctatggtatgaattgggtatgatagacccctggacagggctttgagtggatgtgatggatcatcacctacactgggaacccaacgtatacccacggcttcacaggatggtttgtcttctccatggacacgtctgtcagcacggcgtgtcttcagatcagcagcctaaaggctgaggacacggccgagtattactgtgcga

SEQ ID NO: 6123 - DNA, 296 bp, Homo sapiens
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctccatggacacctctgccagcacagcatacctgcagatcagcagcctaaaggctgaggacatggccatgtattactgtgcgagata

SEQ ID NO: 6124 - DNA, 26 bp, Artificial Sequence
  TCR gamma primer
ggaggggaaggccccacagtgtcttc

SEQ ID NO: 6125 - DNA, 28 bp, Artificial Sequence
  TCR gamma primer
ccaaatcaggctttggagcacctgatct

SEQ ID NO: 6126 - DNA, 27 bp, Artificial Sequence
  TCR gamma primer
caaaggcttagaatatttattacatgt

SEQ ID NO: 6127 - DNA, 27 bp, Artificial Sequence
  TCR gamma primer
tgaagtcatacagttcctggtgtccat

SEQ ID NO: 6128 - DNA, 36 bp, Artificial Sequence
  IGHV primer
  misc_feature (8)..(8): n = A, T, C or G
tgggtgcnacaggcccctggacaagggcttgagtgg

SEQ ID NO: 6129 - DNA, 36 bp, Artificial Sequence
  IGHV primer
tgggtgcgacaggctcctggaaaagggcttgagtgg

SEQ ID NO: 6130 - DNA, 36 bp, Artificial Sequence
  IGHV primer
tgggtgcgccaggcccccggacaaaggcttgagtgg

SEQ ID NO: 6131 - DNA, 36 bp, Artificial Sequence
  IGHV primer
tgggtgcgacaggcccccggacaagcgcttgagtgg

SEQ ID NO: 6132 - DNA, 36 bp, Artificial Sequence
  IGHV primer
tgggtgcgacaggcccccagacaagcgcttgagtgg

SEQ ID NO: 6133 - DNA, 36 bp, Artificial Sequence
  IGHV primer
tgggtgcgacaggctcgtggacaacgccttgagtgg

SEQ ID NO: 6134 - DNA, 36 bp, Artificial Sequence
  IGHV primer
tggttgcaacaggcccctggacaagggcttgaaagg

SEQ ID NO: 6135 - DNA, 36 bp, Artificial Sequence
  IGHV primer
tgggtgcgacaggccactggacaagggcttgagtgg

SEQ ID NO: 6136 - DNA, 36 bp, Artificial Sequence
  IGHV primer
tgggtgcaacagtcccctggacaagggcttgagtgg

SEQ ID NO: 6137 - DNA, 36 bp, Artificial Sequence
  IGHV primer
tgggtgcaacaggcccctggaaaagggcttgagtgg

SEQ ID NO: 6138 - DNA, 36 bp, Artificial Sequence
  IGHV primer
  misc_feature (31)..(31): n = A, T, C or G
tgggtgtgacaaagccctggacaagggcatnagtgg

SEQ ID NO: 6139 - DNA, 36 bp, Artificial Sequence
  IGHV primer
tgggtgcgacaggcccctggacaagagcttgggtgg

SEQ ID NO: 6140 - DNA, 36 bp, Artificial Sequence
  IGHV primer
tgggtgtgacaggcccctgaacaagggcttgagtgg

SEQ ID NO: 6141 - DNA, 36 bp, Artificial Sequence
  IGHV primer
tggatgcgccaggcccctggacaaaggcttgagtgg

SEQ ID NO: 6142 - DNA, 36 bp, Artificial Sequence
  IGHV primer
tggatgcgccaggcccctggacaaggcttcgagtgg

SEQ ID NO: 6143 - DNA, 36 bp, Artificial Sequence
  IGHV primer
tgggtgtgacaggcccctggacaaggacttgagtgg

SEQ ID NO: 6144 - DNA, 36 bp, Artificial Sequence
  IGHV primer
tgggtgcaccaggtccatgcacaagggcttgagtgg

SEQ ID NO: 6145 - DNA, 36 bp, Artificial Sequence
  IGHV primer
tgggtgcgccaggtccatgcacaagggcttgagtgg

SEQ ID NO: 6146 - DNA, 36 bp, Artificial Sequence
  IGHV primer
tgggtgtgccaggcccatgcacaagggcttgagtgg

SEQ ID NO: 6147 - DNA, 36 bp, Artificial Sequence
  IGHV primer
tagatctgtcagccctcagcaaaggccctggagtgg

SEQ ID NO: 6148 - DNA, 36 bp, Artificial Sequence
  IGHV primer
tggatccgtcagcccccagggaaggccctggagtgg

SEQ ID NO: 6149 - DNA, 36 bp, Artificial Sequence
  IGHV primer
tggatccgtcagcccccaggaaaggccctggagtgg

SEQ ID NO: 6150 - DNA, 36 bp, Artificial Sequence
  IGHV primer
tggatccgtcagcccccggggaaggccctggagtgg

SEQ ID NO: 6151 - DNA, 36 bp, Artificial Sequence
  IGHV primer
tgggtccgccaggctccagggaaagggctggagtgg

SEQ ID NO: 6152 - DNA, 36 bp, Artificial Sequence
  IGHV primer
tgggtccggcaagctccagggaagggcctggagtgg

SEQ ID NO: 6153 - DNA, 36 bp, Artificial Sequence
  IGHV primer
tggatccgccaggctccagggaaggggctggagtgg

SEQ ID NO: 6154 - DNA, 36 bp, Artificial sequence
  IGHV primer
tgggtccgccaagctacaggaaaaggtctggagtgg

SEQ ID NO: 6155 - DNA, 36 bp, Artificial Sequence
  IGHV primer
tgggtccgccaggctccagggaaggggctggagtgg

SEQ ID NO: 6156 - DNA, 36 bp, Artificial Sequence
  IGHV primer
tgggcccgcaaggctccaggaaaggggctggagtgg

SEQ ID NO: 6157 - DNA, 36 bp, Artificial Sequence
  IGHV primer
tgggtccgccaggctccaggaaaggggctggagtgg

SEQ ID NO: 6158 - DNA, 36 bp, Artificial Sequence
  IGHV primer
tgggtccgccaagctccagggaaggggctggagtgg

SEQ ID NO: 6159 - DNA, 36 bp, Artificial Sequence
  IGHV primer
ggggtccgccaggctcccgggaaggggctggaatgg

SEQ ID NO: 6160 - DNA, 36 bp, Artificial Sequence
  IGHV primer
tgtgtccgccaggctccagggaatgggctggagttg

SEQ ID NO: 6161 - DNA, 36 bp, Artificial Sequence
  IGHV primer
tgggtccgccaggctccaggcaaggggctagagtgg

SEQ ID NO: 6162 - DNA, 36 bp, Artificial Sequence
  IGHV primer
tgggtccgccaggctccaggcaaggggctggagtgg

SEQ ID NO: 6163 - DNA, 36 bp, Artificial Sequence
  IGHV primer
tgggtccgccaggccccaggcaaggggctagagtgg

SEQ ID NO: 6164 - DNA, 36 bp, Artificial Sequence
  IGHV primer
tgggtccgccaggctccgggcaaggggctagagtgg

SEQ ID NO: 6165 - DNA, 36 bp, Artificial Sequence
  IGHV primer
cgagttcaccagtctccaggcaaggggctggagtga

SEQ ID NO: 6166 - DNA, 36 bp, Artificial Sequence
  IGHV primer
tgggtccatcaggctccaggaaaggggctggagtgg

SEQ ID NO: 6167 - DNA, 36 bp, Artificial Sequence
  IGHV primer
tgggtccgtcaagctccggggaagggtctggagtgg

SEQ ID NO: 6168 - DNA, 36 bp, Artificial Sequence
  IGHV primer
tgggtccgtcaagctccagggaagggtctggagtgg

SEQ ID NO: 6169 - DNA, 36 bp, Artificial Sequence
  IGHV primer
tgggttcgccgggctccagggaagggtctggagtgg

SEQ ID NO: 6170 - DNA, 36 bp, Artificial Sequence
  IGHV primer
tgggttcgccgggctccagggaagggtccggagtgg

SEQ ID NO: 6171 - DNA, 36 bp, Artificial Sequence
  IGHV primer
tggttccgccaggctccagggaaggggctggagtgg

SEQ ID NO: 6172 - DNA, 36 bp, Artificial Sequence
  IGHV primer
tgggtctgccaggctccggagaaggggctggagtgg

SEQ ID NO: 6173 - DNA, 36 bp, Artificial Sequence
  IGHV primer
tgggtctgccaggctccggagaaggggcaggagtgg

SEQ ID NO: 6174 - DNA, 36 bp, Artificial Sequence
  IGHV primer
tgggtccgccagcctccagggaaggggctggagtgg

SEQ ID NO: 6175 - DNA, 36 bp, Artificial Sequence
  IGHV primer
tcagattcccaagctccagggaaggggctggagtga

SEQ ID NO: 6176 - DNA, 36 bp, Artificial Sequence
  IGHV primer
tcagattcccaggctccagggaaggggctggagtga

SEQ ID NO: 6177 - DNA, 36 bp, Artificial Sequence
  IGHV primer
tgggtccgccaggctccaagaaagggtttgtagtgg

SEQ ID NO: 6178 - DNA, 36 bp, Artificial Sequence
  IGHV primer
tgggtcaatgagactctagggaaggggctggaggga

SEQ ID NO: 6179 - DNA, 36 bp, Artificial Sequence
  IGHV primer
tgggtccgccaggctccagggaagggactggaatat

SEQ ID NO: 6180 - DNA, 36 bp, Artificial Sequence
  IGHV primer
tgggtccgccaggctcccgggaaggggctggagtgg

SEQ ID NO: 6181 - DNA, 36 bp, Artificial Sequence
  IGHV primer
tgggtccgccaggcttccgggaaagggctggagtgg

SEQ ID NO: 6182 - DNA, 36 bp, Artificial Sequence
  IGHV primer
tgggtccgccaagctccagggaaggggctggtgtgg

SEQ ID NO: 6183 - DNA, 36 bp, Artificial Sequence
  IGHV primer
tgggtccgccaggctccagggaagggtctggagtgg

SEQ ID NO: 6184 - DNA, 36 bp, Artificial Sequence
  IGHV primer
tgggtccgccaggctcaagggaaagggctagagttg

SEQ ID NO: 6185 - DNA, 36 bp, Artificial Sequence
  IGHV primer
tgggtccgccaggctccagggaagggactggagtgg

SEQ ID NO: 6186 - DNA, 36 bp, Artificial Sequence
  IGHV primer
tgggttcgccaggctccaggaaaaggtctggagtgg

SEQ ID NO: 6187 - DNA, 36 bp, Artificial Sequence
  IGHV primer
tggatccaccaggctccagggaagggtctggagtgg

SEQ ID NO: 6188 - DNA, 36 bp, Artificial Sequence
  IGHV primer
tgggtccgccaatctccagggaaggggctggtgtga

SEQ ID NO: 6189 - DNA, 36 bp, Artificial Sequence
  IGHV primer
tgggtcctctaggctccaggaaaggggctggagtgg

SEQ ID NO: 6190 - DNA, 36 bp, Artificial Sequence
  IGHV primer
tggatccggcagcccccagggaagggactggagtgg

SEQ ID NO: 6191 - DNA, 36 bp, Artificial Sequence
  IGHV primer
tggatccggcagccaccagggaagggcctggagtgg

SEQ ID NO: 6192 - DNA, 36 bp, Artificial Sequence
  IGHV primer
tggatccgccagcccccagggaagggcctggagtgg

SEQ ID NO: 6193 - DNA, 36 bp, Artificial Sequence
  IGHV primer
  misc_feature (14)..(14): n = A, T, C or G
tggatccgccagcncccagggaagggcctggagtgg

SEQ ID NO: 6194 - DNA, 36 bp, Artificial Sequence
  IGHV primer
tggatccgccagcacccagggaagggcctggagtgg

SEQ ID NO: 6195 - DNA, 36 bp, Artificial Sequence
  IGHV primer
tggatccgccagcccccagggaaggggctggagtgg

SEQ ID NO: 6196 - DNA, 36 bp, Artificial Sequence
  IGHV primer
tggatccgccagcccctagggaaggggctggagtgg

SEQ ID NO: 6197 - DNA, 36 bp, Artificial Sequence
  IGHV primer
tggatccgccagcccccagggaagggactggagtgg

SEQ ID NO: 6198 - DNA, 36 bp, Artificial Sequence
  IGHV primer
tggatccggcagcccccagggaaggggctggagtgg

SEQ ID NO: 6199 - DNA, 36 bp, Artificial Sequence
  IGHV primer
tgggtccgccagcccccagggaaggggctggagtgg

SEQ ID NO: 6200 - DNA, 36 bp, Artificial Sequence
  IGHV primer
tggatccggcagcccgccgggaagggactggagtgg

SEQ ID NO: 6201 - DNA, 36 bp, Artificial Sequence
  IGHV primer
tggatccggcagccgccggggaagggactggagtgg

SEQ ID NO: 6202 - DNA, 36 bp, Artificial Sequence
  IGHV primer
tggatccggcagcccgctgggaagggcctggagtgg

SEQ ID NO: 6203 - DNA, 36 bp, Artificial Sequence
  IGHV primer
tggatccggcagcccgccgggaaggggctggagtgg

SEQ ID NO: 6204 - DNA, 36 bp, Artificial Sequence
  IGHV primer
tgggtgcgccagatgcccgggaaaggcctggagtgg

SEQ ID NO: 6205 - DNA, 36 bp, Artificial Sequence
  IGHV primer
tgggtgcgccagatgcccgggaaaggcttggagtgg

SEQ ID NO: 6206 - DNA, 36 bp, Artificial Sequence
  IGHV primer
tgggtgcgccagatgcccaggaaaggcctggagtgg

SEQ ID NO: 6207 - DNA, 36 bp, Artificial Sequence
  IGHV primer
tgggtgcgccagatgcccgggaaagaactggagtgg

SEQ ID NO: 6208 - DNA, 36 bp, Artificial Sequence
  IGHV primer
tggatcaggcagtccccatcgagaggccttgagtgg

SEQ ID NO: 6209 - DNA, 36 bp, Artificial Sequence
  IGHV primer
tgcgacaggcccctggacaagggcttgagtggatgg

SEQ ID NO: 6210 - DNA, 36 bp, Artificial Sequence
  IGHV primer
tgggtatgatagacccctggacagggctttgagtgg

SEQ ID NO: 6211 - DNA, 36 bp, Artificial Sequence
  IGHV primer
tgggtgccacaggcccctggacaagggcttgagtgg

SEQ ID NO: 6212 - DNA, 33 bp, Artificial Sequence
  TCR gamma primer
atcacgagtgttgttccactgccaaagagtttc

SEQ ID NO: 6213 - DNA, 33 bp, Artificial Sequence
  TCR gamma primer
atcacgagctttgttccgggaccaaataccttg

SEQ ID NO: 6214 - DNA, 33 bp, Artificial Sequence
  TCR gamma primer
atcacgcttagtcccttcagcaaatatcttgaa

SEQ ID NO: 6215 - DNA, 33 bp, Artificial Sequence
  TCR gamma primer
atcacgcctagtcccttttgcaaacgtcttgat

SEQ ID NO: 6216 - DNA, 27 bp, Artificial Sequence
  IGHJ primer
gctccccgctatccccagacagcagac

SEQ ID NO: 6217 - DNA, 27 bp, Artificial Sequence
  IGHJ primer
agactgggagggggctgcagtgggact

SEQ ID NO: 6218 - DNA, 28 bp, Artificial Sequence
  IGHJ primer
agagaaaggaggcagaaggaaagccatc

SEQ ID NO: 6219 - DNA, 28 bp, Artificial Sequence
  IGHJ primer
cttcagagttaaagcaggagagaggttg

SEQ ID NO: 6220 - DNA, 28 bp, Artificial Sequence
  IGHJ primer
tccctaagtggactcagagagggggtgg

SEQ ID NO: 6221 - DNA, 28 bp, Artificial Sequence
  IGHJ primer
gaaaacaaaggccctagagtggccattc

SEQ ID NO: 6222 - DNA, 36 bp, Artificial Sequence
  TRBV25-1 primer
ggagatctttcctctgagtcaacagtctccagaata

SEQ ID NO: 6223 - DNA, 30 bp, Artificial Sequence
  TRBV12-1 primer
ggattgattctcagcacagatgcctgatgt

SEQ ID NO: 6224 - DNA, 32 bp, Artificial Sequence
  TRBV12-5 primer
gattctcagcagagatgcctgatgcaacttta

SEQ ID NO: 6225 - DNA, 41 bp, Artificial Sequence
  TRBV2 primer
aagtctgaaatattcgatgatcaattctcagttgaaaggcc

SEQ ID NO: 6226 - DNA, 26 bp, Artificial Sequence
  TRBV16 primer
agctaagtgcctcccaaattcaccct

SEQ ID NO: 6227 - DNA, 25 bp, Artificial Sequence
  TRBV5-1 primer
cgattctcagggcgccagttctcta

SEQ ID NO: 6228 - DNA, 29 bp, Artificial Sequence
  TRBV14 primer
tcttagctgaaaggactggagggacgtat

SEQ ID NO: 6229 - DNA, 32 bp, Artificial Sequence
  TRBV12-4 primer
gaggatcgattctcagctaagatgcctaatgc

SEQ ID NO: 6230 - DNA, 29 bp, Artificial Sequence
  TRBV28 primer
tcctgaggggtacagtgtctctagagaga

SEQ ID NO: 6231 - DNA, 34 bp, Artificial Sequence
  TRBV27 primer
gatgttcctgaagggtacaaagtctctcgaaaag

SEQ ID NO: 6232 - DNA, 30 bp, Artificial Sequence
  TRBV5-4 primer
ctcctagattctcaggtctccagttcccta

SEQ ID NO: 6233 - DNA, 25 bp, Artificial Sequence
  TRBV7-1 primer
cgtgatcggttctctgcacagaggt

SEQ ID NO: 6234 - DNA, 25 bp, Artificial Sequence
  TRBV19 primer
gctgaagggtacagcgtctctcggg

SEQ ID NO: 6235 - DNA, 25 bp, Artificial Sequence
  TRBV5-3 primer
cgattctcagggcgccagttccatg

SEQ ID NO: 6236 - DNA, 33 bp, Artificial Sequence
  TRBV9 primer
caacagttccctgacttgcactctgaactaaac

SEQ ID NO: 6237 - DNA, 33 bp, Artificial Sequence
  TRBV6-7 primer
agaagttcccaatggctacaatgtctccagatc

SEQ ID NO: 6238 - DNA, 31 bp, Artificial Sequence
  TRBV6-4 primer
aagtccctgatggttatagtgtctccagagc

SEQ ID NO: 6239 - DNA, 29 bp, Artificial Sequence
  TRBV6-1 primer
gtccccaatggctacaatgtctccagatt

SEQ ID NO: 6240 - DNA, 27 bp, Artificial Sequence
  TRBV7-9 primer
ttctctgcagagaggcctaagggatct

SEQ ID NO: 6241 - DNA, 24 bp, Artificial Sequence
  TRBV7-3 primer
gcccaacgatcggttctttgcagt

SEQ ID NO: 6242 - DNA, 23 bp, Artificial Sequence
  TRBV7-4 primer
ccagtggtcggttctctgcagag

SEQ ID NO: 6243 - DNA, 28 bp, Artificial Sequence
  TRBV5-6 primer
gcaacttccctgatcgattctcaggtca

SEQ ID NO: 6244 - DNA, 33 bp, Artificial Sequence
  TRBV5-8 primer
cagaggaaacttccctcctagattttcaggtcg

SEQ ID NO: 6245 - DNA, 26 bp, Artificial Sequence
  TRBV7-8 primer
gcccagtgatcgcttctttgcagaaa

SEQ ID NO: 6246 - DNA, 26 bp, Artificial Sequence
  TRBV12-2 primer
cgattctcagctgagaggcctgatgg

SEQ ID NO: 6247 - DNA, 30 bp, Artificial Sequence
  TRBV15 primer
aggccgaacacttctttctgctttcttgac

SEQ ID NO: 6248 - DNA, 27 bp, Artificial Sequence
  TRBV6-2 primer
caaaggagaggtccctgatggctacaa

SEQ ID NO: 6249 - DNA, 28 bp, Artificial Sequence
  TRBV23-1 primer
gattctcatctcaatgccccaagaacgc

SEQ ID NO: 6250 - DNA, 31 bp, Artificial Sequence
  TRBV10-2 primer
cagataaaggagaagtccccgatggctatgt

SEQ ID NO: 6251 - DNA, 24 bp, Artificial Sequence
  TRBV30 primer
caggaccggcagttcatcctgagt

SEQ ID NO: 6252 - DNA, 36 bp, Artificial Sequence
  TRBV10-3 primer
agatactgacaaaggagaagtctcagatggctatag

SEQ ID NO: 6253 - DNA, 30 bp, Artificial Sequence; identical to SEQ ID NO: 1651
  TRBV6-6 primer

SEQ ID NO: 6254 - DNA, 31 bp, Artificial Sequence
  TRBV13 primer
ccctgatcgattctcagctcaacagttcagt

SEQ ID NO: 6255 - DNA, 30 bp, Artificial Sequence
  TRBV4-1 primer
cctgaatgccccaacagctctctcttaaac

SEQ ID NO: 6256 - DNA, 30 bp, Artificial Sequence
  TRBV4-3 primer
cctgaatgccccaacagctctcacttattc

SEQ ID NO: 6257 - DNA, 37 bp, Artificial Sequence
  TRBV26 primer
ggagatgtctctgagaggtatcatgtttcttgaaata

SEQ ID NO: 6258 - DNA, 37 bp, Artificial Sequence
  TRBV6-8 primer
tacaatgtctctagattaaacacagaggatttcccac

SEQ ID NO: 6259 - DNA, 30 bp, Artificial Sequence
  TRBV3-2 primer
ttctcacctgactctccagacaaagctcat

SEQ ID NO: 6260 - DNA, 30 bp, Artificial Sequence
  TRBV11-2 primer
cctaaggatcgattttctgcagagaggctc

SEQ ID NO: 6261 - DNA, 29 bp, Artificial Sequence
  TRBV2 primer
cctgaatgccctgacagctctcgcttata

SEQ ID NO: 6262 - DNA, 37 bp, Artificial Sequence
  TRBV3-1 primer
gcttctcacctaaatctccagacaaagctcacttaaa

SEQ ID NO: 6263 - DNA, 29 bp, Artificial Sequence
  TRBV29-1 primer
catcagccgcccaaacctaacattctcaa

SEQ ID NO: 6264 - DNA, 29 bp, Artificial Sequence
  TRBV18 primer
attttctgctgaatttcccaaagagggcc

SEQ ID NO: 6265 - DNA, 29 bp, Artificial Sequence
  TRBV17 primer
attcacagctgaaagacctaacggaacgt

SEQ ID NO: 6266 - DNA, 26 bp, Artificial Sequence
  TRBV20-1 primer
caagcctgaccttgtccactctgaca

SEQ ID NO: 6267 - DNA, 24 bp, Artificial Sequence
  TRBV7-6 primer
ggttctctgcagagaggcctgagg

SEQ ID NO: 6268 - DNA, 34 bp, Artificial Sequence
  TRBV24-1 primer
gagagatctctgatggatacagtgtctctcgaca

SEQ ID NO: 6269 - DNA, 26 bp, Artificial Sequence
  TRBV7-2 primer
gatcgcttctctgcagagaggactgg

SEQ ID NO: 6270 - DNA, 29 bp, Artificial Sequence
  TRBV6-9 primer
aaggagaagtccccgatggctacaatgta

SEQ ID NO: 6271 - DNA, 29 bp, Artificial Sequence
  TRBV6-5 primer
aaggagaagtccccaatggctacaatgtc

SEQ ID NO: 6272 - DNA, 30 bp, Artificial Sequence; identical to SEQ ID NO: 1689
  TRBV5-5 primer

SEQ ID NO: 6273 - DNA, 35 bp, Artificial Sequence
  TRBV10-1 primer
gacactaacaaaggagaagtctcagatggctacag

SEQ ID NO: 6274 - DNA, 35 bp, Artificial Sequence; identical to SEQ ID NO: 1631
  TRBJ1-1 primer

SEQ ID NO: 6275 - DNA, 30 bp, Artificial Sequence
  TRBJ1-2 primer
tacaacggttaacctggtccccgaaccgaa

SEQ ID NO: 6276 - DNA, 34 bp, Artificial Sequence
  TRBJ1-3 primer
acctacaacagtgagccaacttccctctccaaaa

SEQ ID NO: 6277 - DNA, 31 bp, Artificial Sequence
  TRBJ1-4 primer
caagacagagagctgggttccactgccaaaa

SEQ ID NO: 6278 - DNA, 33 bp, Artificial Sequence; identical to SEQ ID NO: 1635
  TRBJ1-5 primer

SEQ ID NO: 6279 - DNA, 28 bp, Artificial Sequence
  TRBJ1-6 primer
tcacagtgagcctggtcccgttcccaaa

SEQ ID NO: 6280 - DNA, 25 bp, Artificial Sequence
  TRBJ2-1 primer
cggtgagccgtgtccctggcccgaa

SEQ ID NO: 6281 - DNA, 31 bp, Artificial Sequence; identical to SEQ ID NO: 1638
  TRBJ2-2 primer

SEQ ID NO: 6282 - DNA, 26 bp, Artificial Sequence
  TRBJ2-3 primer
actgtcagccgggtgcctgggccaaa

SEQ ID NO: 6283 - DNA, 22 bp, Artificial Sequence
  TRBJ2-4 primer
agagccgggtcccggcgccgaa

SEQ ID NO: 6284 - DNA, 22 bp, Artificial Sequence
  TRBJ2-5 primer
ggagccgcgtgcctggcccgaa

SEQ ID NO: 6285 - DNA, 23 bp, Artificial Sequence
  TRBJ2-6 primer
gtcagcctgctgccggccccgaa

SEQ ID NO: 6286 - DNA, 23 bp, Artificial Sequence
  TRBJ2-7 primer
gtgagcctggtgcccggcccgaa

SEQ ID NO: 6287 - DNA, 22 bp, Artificial Sequence
  TCRBV01p probe
actgcagcaagaagactcagct

SEQ ID NO: 6288 - DNA, 20 bp, Artificial Sequence
  TCRBV02 probe
aagatccggtccacaaagct

SEQ ID NO: 6289 - DNA, 22 bp, Artificial Sequence
  TCRBV03-1 probe
aattccctggagcttggtgact

SEQ ID NO: 6290 - DNA, 22 bp, Artificial Sequence
  TCRBV03-2p probe
aattccctggagcttggtgact

SEQ ID NO: 6291 - DNA, 22 bp, Artificial Sequence
  TCRBV04-1 probe
cagaagactcagccctgtatct

SEQ ID NO: 6292 - DNA, 21 bp, Artificial Sequence
  TCRBV04-2 probe
agaagactcggccctgtatct

SEQ ID NO: 6293 - DNA, 21 bp, Artificial Sequence
  TCRBV04-3 probe
agaagactcggccctgtatct

SEQ ID NO: 6294 - DNA, 20 bp, Artificial Sequence
  TCRBV05-1 probe
aatgtgagcaccttggagct

SEQ ID NO: 6295 - DNA, 20 bp, Artificial Sequence
  TCRBV05-2p probe
actgagtcaaacacggagct

SEQ ID NO: 6296 - DNA, 21 bp, Artificial Sequence
  TCRBV05-5 probe
  misc_feature (21)..(21): n is a, c, g, or t
aatgtgagtgccttggagctn

SEQ ID NO: 6297 - DNA, 20 bp, Artificial Sequence
  TCRBV05-4 probe
aatgtgaacgccttggagct

SEQ ID NO: 6298 - DNA, 18 bp, Artificial Sequence
  TCRBV05-5 probe
tgtgaacgccttgttgct

SEQ ID NO: 6299 - DNA, 18 bp, Artificial Sequence
  TCRBV05-6 probe
tgtgaacgccttgttgct

SEQ ID NO: 6300 - DNA, 18 bp, Artificial Sequence
  TCRBV05-7 probe
tgtgaacgccttgttgct

SEQ ID NO: 6301 - DNA, 18 bp, Artificial Sequence
  TCRBV05-8 probe
tgtgaacgccttgttgct

SEQ ID NO: 6302 - DNA, 22 bp, Artificial Sequence
  TCRBV06-1 probe
cctcccagacatctgtgtactt

SEQ ID NO: 6303 - DNA, 20 bp, Artificial Sequence
  TCRBV06-2 probe
tccctcccaaacatctgtgt

SEQ ID NO: 6304 - DNA, 20 bp, Artificial Sequence
  TCRBV06-3 probe
tccctcccaaacatctgtgt

SEQ ID NO: 6305 - DNA, 22 bp, Artificial Sequence
  TCRBV06-4 probe
tgctgtaccctctcagacatct

SEQ ID NO: 6306 - DNA, 22 bp, Artificial Sequence
  TCRBV06-5 probe
cctcccagacatctgtgtactt

SEQ ID NO: 6307 - DNA, 22 bp, Artificial Sequence
  TCRBV06-6 probe
cctcccagacatctgtgtactt

SEQ ID NO: 6308 - DNA, 22 bp, Artificial Sequence
  TCRBV06-7 probe
tgctccctctcagacttctgtt

SEQ ID NO: 6309 - DNA, 22 bp, Artificial Sequence
  TCRBV06-8 probe
cctcccagacatctgtgtactt

SEQ ID NO: 6310 - DNA, 20 bp, Artificial Sequence
  TCRBV06-9 probe
tccctcccagacatctgtat

SEQ ID NO: 6311 - DNA, 17 bp, Artificial Sequence
  TCRBV07-1 probe
aagttccagcgcacaca

SEQ ID NO: 6312 - DNA, 17 bp, Artificial Sequence
  TCRBV07-2 probe
atccagcgcacacagca

SEQ ID NO: 6313 - DNA, 17 bp, Artificial Sequence
  TCRBV07-3 probe
aagatccagcgcacaga

SEQ ID NO: 6314 - DNA, 17 bp, Artificial Sequence
  TCRBV07-4 probe
aagatccagcgcacaga

SEQ ID NO: 6315 - DNA, 18 bp, Artificial Sequence
  TCRBV07-5p probe
atccagcgcacagagcaa

SEQ ID NO: 6316 - DNA, 17 bp, Artificial Sequence
  TCRBV07-6 probe
atccagcgcacagagca

SEQ ID NO: 6317 - DNA, 17 bp, Artificial Sequence
  TCRBV07-7 probe
attcagcgcacagagca

SEQ ID NO: 6318 - DNA, 17 bp, Artificial Sequence
  TCRBV07-8 probe
aagatccagcgcacaca

SEQ ID NO: 6319 - DNA, 17 bp, Artificial Sequence
  TCRBV07-9 probe
atccagcgcacagagca

SEQ ID NO: 6320 - DNA, 20 bp, Artificial Sequence
  TCRBV08-1p probe
aaccctggagtctactagca

SEQ ID NO: 6321 - DNA, 20 bp, Artificial Sequence
  TCRBV08-2p probe
agccagacctatctgtacca

SEQ ID NO: 6322 - DNA, 16 bp, Artificial Sequence
  TCRBV09 probe
agctctctggagctgg

SEQ ID NO: 6323 - DNA, 22 bp, Artificial Sequence
  TCRBV10-1 probe
cctcctcccagacatctgtata

SEQ ID NO: 6324 - DNA, 22 bp, Artificial Sequence
  TCRBV10-2 probe
cgctcccagacatctgtgtatt

SEQ ID NO: 6325 - DNA, 22 bp, Artificial Sequence
  TCRBV10-3 probe
agctcccagacatctgtgtact

SEQ ID NO: 6326 - DNA, 21 bp, Artificial Sequence
  TCRBV11-1 probe
aagatccagcctgcagagctt

SEQ ID NO: 6327 - DNA, 20 bp, Artificial Sequence
  TCRBV11-2 probe
atccagcctgcaaagcttga

SEQ ID NO: 6328 - DNA, 21 bp, Artificial Sequence
  TCRBV11-3 probe
aagatccagcctgcagagctt

SEQ ID NO: 6329 - DNA, 22 bp, Artificial Sequence
  TCRBV12-1p probe
ccagggacttgggcctatattt

SEQ ID NO: 6330 - DNA, 20 bp, Artificial Sequence
  TCRBV12-2p probe
aagatccagcctgcagagca

SEQ ID NO: 6331 - DNA, 20 bp, Artificial Sequence
  TCRBV12-3 probe
agggactcagctgtgtactt

SEQ ID NO: 6332 - DNA, 20 bp, Artificial Sequence
  TCRBV12-4 probe
agggactcagctgtgtactt

SEQ ID NO: 6333 - DNA, 22 bp, Artificial Sequence
  TCRBV12-5 probe
ccagggactcagctgtgtattt

SEQ ID NO: 6334 - DNA, 20 bp, Artificial Sequence
  TCRBV13 probe
aacatgagctccttggagct

SEQ ID NO: 6335 - DNA, 22 bp, Artificial Sequence
  TCRBV14 probe
tgcagaactggaggattctgga

SEQ ID NO: 6336 - DNA, 16 bp, Artificial Sequence
  TCRBV15 probe
acgcagccatgtacct

SEQ ID NO: 6337 - DNA, 20 bp, Artificial Sequence
  TCRBV16 probe
atccaggctacgaagcttga

SEQ ID NO: 6338 - DNA, 20 bp, Artificial Sequence
  TCRBV17p probe
agggactcagccgtgtatct

SEQ ID NO: 6339 - DNA, 22 bp, Artificial Sequence
  TCRBV18 probe
cgaggagattcggcagcttatt

SEQ ID NO: 6340 - DNA, 18 bp, Artificial Sequence
  TCRBV19 probe
agaacccgacagctttct

SEQ ID NO: 6341 - DNA, 20 bp, Artificial Sequence
  TCRBV20-1 probe
tcctgaagacagcagcttct

SEQ ID NO: 6342 - DNA, 20 bp, Artificial Sequence
  TCRBV21-1p probe
agatccagtccacggagtca

SEQ ID NO: 6343 - DNA, 18 bp, Artificial Sequence
  TCRBV22p probe
acaccagccaaacagctt

SEQ ID NO: 6344 - DNA, 19 bp, Artificial Sequence
  TCRBV23-1p probe
ggcaatcctgtcctcagaa

SEQ ID NO: 6345 - DNA, 22 bp, Artificial Sequence
  TCRBV24-1 probe
cccaaccagacagctctttact

SEQ ID NO: 6346 - DNA, 22 bp, Artificial Sequence
  TCRBV25-1 probe
cctcacatacctctcagtacct

SEQ ID NO: 6347 - DNA, 20 bp, Artificial Sequence
  TCRBV26p probe
agcaccaaccagacatctgt

SEQ ID NO: 6348 - DNA, 22 bp, Artificial Sequence
  TCRBV27-1 probe
ccaaccagacctctctgtactt

SEQ ID NO: 6349 - DNA, 18 bp, Artificial Sequence
  TCRBV28 probe
agcaccaaccagacatct

SEQ ID NO: 6350 - DNA, 20 bp, Artificial Sequence
  TCRBV29-1 probe
tgagcaacatgagccctgaa

SEQ ID NO: 6351 - DNA, 22 bp, Artificial Sequence
  TCRBV30 probe
tccttctcagtgactctggctt

SEQ ID NO: 6352 - DNA, 36 bp, Artificial Sequence
  TCRB CDR3 Sequence
tgtgccagcagttactccgccgaaaaatgaaaaact

SEQ ID NO: 6353 - DNA, 47 bp, Artificial Sequence
  TCRB CDR3 Sequence
tgtgccagcagccccggtcgcagccaagtgtctggggccaacgtcct

SEQ ID NO: 6354 - DNA, 38 bp, Artificial Sequence
  TCRB CDR3 Sequence
tgtgccagcagttactcgcgctccgaacctaatgagca

SEQ ID NO: 6355 - DNA, 38 bp, Artificial Sequence
  TCRB CDR3 Sequence
tgtgccagcagcttaagcgggtaccttaaagagaccca

SEQ ID NO: 6356 - DNA, 41 bp, Artificial Sequence
  TCRB CDR3 Sequence
tgcgccagcaccccgagaggagagcgggagccagatacgca

SEQ ID NO: 6357 - DNA, 47 bp, Artificial Sequence
  TCRB CDR3 Sequence
tgcagtgctagagggcctatgttccgggaccgatcctcctacgagca

SEQ ID NO: 6358 - DNA, 50 bp, Artificial Sequence
  TCRB CDR3 Sequence
tgtgccagcagccaagattttacaggtgcagattctggggccaacgtcct

SEQ ID NO: 6359 - DNA, 53 bp, Artificial Sequence
  TCRB CDR3 Sequence
tgtgccagcagtgaattgaaagacgagaagggtggtttttttgccactgaagc

SEQ ID NO: 6360 - DNA, 47 bp, Artificial Sequence
  TCRB CDR3 Sequence
tgcgccagcagccaagatagagagcgggaggatcgcacagatacgca

SEQ ID NO: 6361 - DNA, 17 bp, Artificial Sequence
  TCRB CDR3 Sequence
tgtccagtcattaccca

SEQ ID NO: 6362 - DNA, 32 bp, Artificial Sequence
  TCRB CDR3 Sequence
tgtgccagcagtttattaggagaggagaccca

SEQ ID NO: 6363 - DNA, 38 bp, Artificial Sequence
  TCRB CDR3 Sequence
tgtgccagcagcttttgtctgtctggggccaacgtcct

SEQ ID NO: 6364 - DNA, 29 bp, Artificial Sequence
  TCRB CDR3 Sequence
tgtgccagcagtgaatacacaggggaagc

SEQ ID NO: 6365 - DNA, 44 bp, Artificial Sequence
  TCRB CDR3 Sequence
tgtgccagcagcctatttactaaaaggggttgtttggatgagca

SEQ ID NO: 6366 - DNA, 59 bp, Artificial Sequence
  TCRB CDR3 Sequence
tgtgccagcagttttcgaactctttcccccgggggcgcaattcggcccaaaaacattca

SEQ ID NO: 6367 - DNA, 26 bp, Artificial Sequence
  TCRB CDR3 Sequence
tgtgccagcagttccacagatacgca

SEQ ID NO: 6368 - DNA, 39 bp, Artificial Sequence
  TCRB CDR3 Sequence
tgtgccagcagccctgacaggggacgagcctggaaacac

SEQ ID NO: 6369 - DNA, 38 bp, Artificial Sequence
  TCRB CDR3 Sequence
tgtgccagcagcccacgggcggataaagatgaaaaact

SEQ ID NO: 6370 - DNA, 53 bp, Artificial Sequence
  TCRB CDR3 Sequence
tgtgccagcagtttgaacacaaaccggcagtgggcgcgagctaactatggcta

SEQ ID NO: 6371 - DNA, 39 bp, Artificial Sequence
  TCRB CDR3 Sequence
tgtgccagcattattttagggtaccctaaactatggcta

SEQ ID NO: 6372 - DNA, 38 bp, Artificial Sequence; identical to SEQ ID NO: 6354
  TCRB CDR3 Sequence

SEQ ID NO: 6373 - DNA, 50 bp, Artificial Sequence
  TCRB CDR3 Sequence
tgcagtgctagagatctactccccctgggggggacgcgtggaaacaccat

SEQ ID NO: 6374 - DNA, 32 bp, Artificial Sequence
  TCRB CDR3 Sequence
tgtgccagtagtcaccctcacacagatacgca

SEQ ID NO: 6375 - DNA, 37 bp, Artificial Sequence
  TCRB CDR3 Sequence
tgtgccagcagttacatttcaggcttaactatggcta

SEQ ID NO: 6376 - DNA, 38 bp, Artificial Sequence
  TCRB CDR3 Sequence
tgtgccagcagtttaataacagttcttctcggggagct

SEQ ID NO: 6377 - DNA, 37 bp, Artificial Sequence
  TCRB CDR3 Sequence
tgtgccagcagtgaaggcgggagagcgcttgggagca

SEQ ID NO: 6378 - DNA, 28 bp, Artificial Sequence
  TCRB CDR3 Sequence
tgcagtgctagagagggtaagagaccca

SEQ ID NO: 6379 - DNA, 41 bp, Artificial Sequence
  TCRB CDR3 Sequence
tgtgccagcagttcctatgacaggggatccattcagcccca

SEQ ID NO: 6380 - DNA, 41 bp, Artificial Sequence
  TCRB CDR3 Sequence
tgtgccagcagtgatgaaaggcggggctcctacaatgagca

SEQ ID NO: 6381 - DNA, 41 bp, Artificial Sequence
  TCRB CDR3 Sequence
tgtgccagcagtctaaccggacagcggtataatgaaaaact

SEQ ID NO: 6382 - DNA, 32 bp, Artificial Sequence
  TCRB CDR3 Sequence
tgtgccagcagcttatgggaaaccggggagct

SEQ ID NO: 6383 - DNA, 23 bp, Artificial Sequence
  Oligonucleotide
ggatgataaataggtgccaagtg

SEQ ID NO: 6384 - DNA, 19 bp, Artificial Sequence
  Oligonucleotide
acttcaatgctgcctggat

SEQ ID NO: 6385 - DNA, 20 bp, Artificial Sequence
  Oligonucleotide
aaggacgagggcgatttcta

SEQ ID NO: 6386 - DNA, 20 bp, Artificial Sequence
  Oligonucleotide
tatctgcgattgcgtgtctg

SEQ ID NO: 6387 - DNA, 20 bp, Artificial Sequence
  Oligonucleotide
ttgcatgatttgtgggaaga

SEQ ID NO: 6388 - DNA, 20 bp, Artificial Sequence
  Oligonucleotide
ttctgaaggcctgtgaaagc

What is claimed is:

1. A method of quantifying the number of input molecules for one or more rearranged DNA sequences identified as indicative of a clonal lymphoid hematological malignancy, comprising:
   (A) amplifying by a single multiplex polymerase chain reaction (PCR):
   (i) a plurality of gene segments from a sample comprising T cells and/or B cells to produce a plurality of sample amplicons, wherein each gene segment comprises rearranged TCRβ CDR3-encoding region or a rearranged Ig CDR3-encoding region comprising a variable (V)-region and a joining (J)-region, and wherein said single multiplex PCR amplifies substantially all rearranged TCRβ CDR3-encoding regions or substantially all rearranged Ig CDR3-encoding regions; and within the single multiplex PCR
   (ii) a known number of a plurality of template oligonucleotides each having a unique oligonucleotide sequence to produce a plurality of template amplicons wherein each of said template oligonucleotides is defined by the formula:

5'-U1-B1-V-B2-R-B3-J-B4-U2-3' wherein V comprises a polynucleotide comprising at least 20 and not more than 1000 contiguous nucleotides of a V-region encoding gene segment or a complement thereof, and wherein V comprises a unique oligonucleotide sequence;

wherein J is a polynucleotide comprising at least 15 and not more than 600 contiguous nucleotides of a J-region encoding gene sequence, or a complement thereof, and wherein J comprises a unique oligonucleotide sequence;

wherein U1 comprises an oligonucleotide having a sequence that is selected from (i) a first universal adaptor oligonucleotide sequence, and (ii) a first sequencing platform-specific oligonucleotide sequence that is linked to and positioned 5' to a first universal adaptor oligonucleotide sequence;

wherein U2 comprises an oligonucleotide having a sequence that is selected from (i) a second universal adaptor oligonucleotide sequence and (ii) a second sequencing platform-specific oligonucleotide sequence that is linked to and positioned 5' to a second universal adaptor oligonucleotide sequence;

wherein B1, B2, B3 and B4 are each independently nothing or each comprises an oligonucleotide barcode sequence, wherein each of the plurality of oligonucleotide barcode sequences comprises a unique oligonucleotide sequence that uniquely identifies, as a paired combination, a unique V oligonucleotide sequence and a unique J oligonucleotide sequence, and wherein R is either nothing or comprises a restriction enzyme recognition site that comprises an oligonucleotide sequence not found in the template oligonucleotide;

(B) sequencing by high throughput sequencing said plurality of sample amplicons and template amplicons to generate sequence reads of said substantially all rearranged TCRβ or Ig CDR3-encoding regions and said unique template oligonucleotides;

(C) counting the number of sequence reads of each unique template oligonucleotide and the number of sequence reads of each rearranged TCRβ or Ig CDR3-encoding region from the sequence reads obtained in step (B);

(D) identifying from the sequence reads of the rearranged TCRβ or Ig CDR3-encoding regions at least one rearranged TCRβ or Ig CDR3-encoding region indicative of a clonal lymphoid hematological malignancy in the sample based on the frequency of the sequence reads of the rearranged TCRβ or Ig CDR3-encoding region as compared to the remaining sequence reads;

(E) calculating an amplification factor by dividing the number of template oligonucleotides counted in (C) by the known number of each of the plurality of template oligonucleotides having a unique oligonucleotide sequence in the template composition amplified in (A)(ii); and (F) dividing the number of sequence reads counted for the at least one rearranged TCRβ or Ig CDR3-encoding regions indicative of a clonal lymphoid hematological malignancy identified in (D) and counted in (C) by the amplification factor calculated in (E) thereby quantifying the number of input molecules of one or more rearranged DNA sequences identified as indicative of a clonal lymphoid hematological malignancy.

2. The method of claim 1, wherein said clonal lymphoid hematological malignancy is selected from: acute T-cell lymphoblastic leukemia (T-ALL), acute B-cell lymphoblastic leukemia (B-ALL), multiple myeloma, plasmacytoma, macroglobulinemia, chronic lymphocytic leukemia (CLL), acute lymphoblastic leukemia (ALL), Hodgkins lymphoma, non-Hodgkins lymphoma, cutaneous T-cell lymphoma, mantle cell lymphoma, peripheral T-cell lymphoma, hairy cell leukemia, T prolymphocytic lymphoma, angioimmunoblastic T-cell lymphoma, T lymphoblastic leukemia/lymphoma, peripheral T-cell lymphoma, adult T cell leukemia/lymphoma, mycosis fungoides, Sezary syndrome, T lymphoblastic leukemia, myeloproliferative neoplasm, and myelodysplastic syndrome.

3. The method of claim 1, wherein said rearranged Ig CDR3-encoding regions are selected from a rearranged IgH CDR3-encoding, region (V-D-J), a partially rearranged IgH CDR3-encoding region (D-J), a rearranged IgK CDR3-encoding region, a deleted IgK rearrangement using the iRSS in lieu of a V segment, a deleted IgK rearrangement using the Kdel in lieu of a J segment, or a rearranged Igλ CDR3-encoding region.

4. The method of claim 3, wherein said rearranged Igκ CDR3-encoding regions comprise a non-coding iRSS sequence and a joining (1) gene segment rearrangement, or a non-coding variable (V) gene segment and the non-coding Kdel element.

5. The method of claim 1 wherein each of said template oligonucleotides comprises at least one unique barcode sequence.

6. The method of claim 5 wherein each of said template oligonucleotides comprises a V region encoding gene sequence or a complement thereof and J region encoding gene sequence or a complement thereof.

7. The method of claim 6 wherein said unique oligonucleotide barcode sequence comprises a random polynucleotide sequence of at least 6 nucleotides.

8. The method of claim 6 wherein each of said plurality of said template oligonucleotides is present in a substantially equimolar amount.

9. The method of claim 6 wherein each of said plurality of said template oligonucleotides has substantially identical lengths.

10. The method of claim 6 wherein each of said V region encoding gene sequences or a complement thereof is unique to a single V region encoding gene and wherein each of said J region encoding gene sequences or a complement thereof is unique to a single J region encoding gene.

11. The method of claim 1, wherein said at least one unique rearranged sequence identified as indicative of a clonal lymphoid hematological malignancy in said subject is identified from a sample obtained from said subject at a time prior to a treatment.

12. The method of claim 1 wherein said sample comprises at least 100,000 T cells or B cells.

13. The method of claim 1 wherein each of said plurality of template oligonucleotides comprises at least one oligonucleotide barcode that is 3-25 contiguous nucleotides in length.

14. The method of claim 1 wherein at least one rearranged TCRβ or Ig CDR3-encoding region is identified as being indicative of a hematological malignancy when it has a relative frequency of at least 15% of the total TCRβ or Ig CDR3-encoding regions counted in step (C).

15. The method of claim 1 wherein at least one rearranged TCRβ or Ig CDR3-encoding region is identified as being indicative of a hematological malignancy when it has a relative frequency of at least one in $10^5$ of the total TCRβ of Ig CDR3-encoding regions counted in step (C).

16. The method of claim 1 wherein said high throughput sequencing is sequencing by synthesis.

17. The method of claim 1 wherein the single PCR uses a plurality of V-segment oligonucleotide primers, each V-segment oligonucleotide primer capable of hybridizing to one or more TCRβ V-regions or one or more Ig V-regions of said plurality of gene segments; and a plurality of J segment oligonucleotide primers, each J-segment primer capable of hybridizing to one or more TCRβ J-regions or one or more Ig J-regions of said plurality of gene segments.

18. The method of claim 17, wherein said plurality of V segment oligonucleotide primers are complementary to at least one TCR Vβ-encoding gene segment.

19. The method of claim 17, wherein said plurality of J-segment oligonucleotide primers are complementary to at least one functional TCR Jβ-encoding gene segment.

20. The method of claim 17 wherein said plurality of said template oligonucleotides is greater than or equal to the lesser of said plurality of said V-segment oligonucleotide primers and said plurality of J-segment oligonucleotide primers.

21. The method of claim 17 wherein said template composition comprises at least one template oligonucleotide amplified by each different pair of said V-segment oligonucleotide primers and said J-segment oligonucleotide primers.

* * * * *